US011884719B2

(12) United States Patent
Lee et al.

(10) Patent No.: US 11,884,719 B2
(45) Date of Patent: Jan. 30, 2024

(54) ANTI-IL-36 ANTIBODIES AND METHODS OF USE THEREOF

(71) Applicant: 23andMe, Inc., Sunnyvale, CA (US)

(72) Inventors: Chingwei Vivian Lee, Foster City, CA (US); Germaine Fuh-Kelly, Pacifica, CA (US); Louise Scharf, Pacifica, CA (US); Tina Thai, San Mateo, CA (US); Ashka Bharat Patel, San Jose, CA (US); Shashank Bharill, Daly City, CA (US); Erik Edward Karrer, Los Altos, CA (US)

(73) Assignee: 23andMe, Inc., Sunnyvale, CA (US)

( * ) Notice: Subject to any disclaimer, the term of this patent is extended or adjusted under 35 U.S.C. 154(b) by 255 days.

(21) Appl. No.: 16/720,541

(22) Filed: Dec. 19, 2019

(65) Prior Publication Data

US 2020/0199217 A1    Jun. 25, 2020

Related U.S. Application Data

(60) Provisional application No. 62/784,316, filed on Dec. 21, 2018.

(51) Int. Cl.
| | |
|---|---|
| *C07K 16/24* | (2006.01) |
| *C07K 16/46* | (2006.01) |
| *A61P 29/00* | (2006.01) |
| *A61K 38/00* | (2006.01) |

(52) U.S. Cl.
CPC ............ *C07K 16/244* (2013.01); *A61P 29/00* (2018.01); *A61K 38/00* (2013.01); *C07K 16/468* (2013.01); *C07K 2317/515* (2013.01); *C07K 2317/56* (2013.01)

(58) Field of Classification Search
None
See application file for complete search history.

(56) References Cited

U.S. PATENT DOCUMENTS

| | | | |
|---|---|---|---|
| 5,863,769 A | 1/1999 | Young | |
| 5,989,830 A * | 11/1999 | Davis | C07K 16/00 435/69.1 |
| 6,737,056 B1 | 5/2004 | Presta | |
| 6,838,290 B2 | 1/2005 | Sims | |
| 6,843,987 B2 | 1/2005 | Debets | |
| 7,261,894 B2 | 8/2007 | Sims | |
| 7,332,581 B2 | 2/2008 | Presta | |
| 7,393,530 B2 | 7/2008 | Timans | |
| 7,612,181 B2 | 11/2009 | Wu | |
| 7,658,921 B2 | 2/2010 | Dall-Acqua | |
| 7,659,375 B2 | 2/2010 | Sims | |
| 8,034,771 B2 | 10/2011 | Sims | |
| 9,023,995 B2 | 5/2015 | Brown | |
| 9,334,331 B2 * | 5/2016 | Igawa | C07K 16/36 |
| 10,011,829 B2 | 7/2018 | Fan | |
| 10,421,807 B2 * | 9/2019 | Gonzales | A61P 17/08 |
| 2002/0068279 A1 | 6/2002 | Burgess | |
| 2003/0032061 A1 | 2/2003 | Eaton | |
| 2003/0166069 A1 | 9/2003 | Welcher | |
| 2003/0224984 A1 | 12/2003 | Baker | |
| 2005/0089957 A1 | 4/2005 | Goddard | |
| 2005/0123512 A1 | 6/2005 | Calzone | |
| 2007/0042466 A1 | 2/2007 | Goddard | |
| 2007/0042945 A1 | 2/2007 | Boday | |
| 2011/0110852 A1 | 5/2011 | Miller | |
| 2011/0159011 A1 | 6/2011 | Carrier | |
| 2012/0195900 A1 | 8/2012 | Wu | |
| 2012/0201746 A1 | 8/2012 | Ghayur | |
| 2013/0102486 A1 | 4/2013 | Attardi | |
| 2014/0154256 A1 | 6/2014 | Wu | |
| 2017/0281716 A1 | 10/2017 | Martin | |
| 2017/0340708 A1 | 11/2017 | Xu | |

FOREIGN PATENT DOCUMENTS

| | | |
|---|---|---|
| WO | 1999035268 A1 | 7/1999 |
| WO | 1999036541 A1 | 7/1999 |
| WO | 2003085096 A2 | 10/2003 |
| WO | 2015086830 A1 | 6/2015 |
| WO | 2015132602 | 9/2015 |
| WO | 2015158765 A1 | 10/2015 |
| WO | 2016168542 A1 | 10/2016 |

OTHER PUBLICATIONS

Al Qaraghuli et al. Antibody-protein binding and conformational changes: identifying allosteric signaling pathways to engineer a better effector response. Nature Scientific Reports 10:13969; (2020). (Year: 2020).*
Tokuriki et al., Stability effects of mutations and protein evolvability. Curr. Opin. Struc. Biol. 19:596-604 (2009). (Year: 2009).*
Fenton et al. Rheostat positions: A new classification of protein positions relevant to pharmacogenomics Medicinal Chemistry Research 29:1133-1146; (2020). (Year: 2020).*
Bhattacharya et al. Impact of genetic variation on three dimensional structure and function of proteins; PLOS One 12(3): e0171355, pp. 1-22, (Mar. 2017). (Year: 2017).*
Gua et al. Protein tolerance to random amino acid change. PNAS USA 101(25):9205-10; (2004). (Year: 2004).*
Edwards et al. The remarkable flexibility of the human antibody repertoire; isolation of over one thousand different antibodies to a single protein, BLyS. Journal of Molecular Biology 334:103-118; (2003). (Year: 2003).*

(Continued)

*Primary Examiner* — Elizabeth C. Kemmerer
*Assistant Examiner* — Regina M DeBerry
(74) *Attorney, Agent, or Firm* — FisherBroyles, LLP; Adam K. Whiting

(57) ABSTRACT

The present invention provides binding proteins, such as antibodies and antigen-binding fragments, which specifically bind to human IL-36 cytokines, IL-36α, IL-36β, and/or IL-36γ, and block the IL-36 stimulated signaling pathways. Compositions comprising such binding proteins and methods of making and using such binding proteins are also provided.

23 Claims, 12 Drawing Sheets

Specification includes a Sequence Listing.

(56) References Cited

OTHER PUBLICATIONS

Lloyd et al. Modelling the human immune response: performance of a 10(11) human antibody repertoire against a broad panel of therapeutically relevant antigens. Protein Engineering, Eng. Design & Selection 22(3): 159-168; (2009). (Year: 2009).*

Goel et al. Plasticity within the antigen-combining site may manifest as molecular mimicry in the humoral immune response. J. Immunol. 173: 7358-7367; (2004). (Year: 2004).*

Khan et al. Adjustable locks and flexible keys: plasticity of epitope-paratope interactions in germline antibodies. J. Immunol. 192: 5398-5405; (2014). (Year: 2014).*

Poosarla et al. Computational De Novo Design of Antibodies Binding to a Peptide With High Affinity. Biotechn. Bioeng. 114(6): 1331-1342 (2017). (Year: 2017).*

Rabia, et al. Understanding and overcoming trade-offs between antibody affinity, specificity, stability and solubility. Biochemical Engineering Journal 137:365-374; (2018). (Year: 2018).*

Morel. Mouse models of human autoimmune diseases: Essential tools that require proper controls, Plos Biology vol. 2/No. 8:1061-1064, (Aug. 2004). (Year: 2004).*

Vajdos et al. Comprehensive functional maps of antigen-binding site of an anti-ErB2 antibody obtained with shotgun scanning mutagenesis. J Mol Biol. vol. 5;320(2):415-28 (2002) (Year: 2002).*

Blumberg, et al., "IL-1RL2 and its ligands contribute to the cytokine network in psoriasis", J Immunol., 2010, 185:4354-62.

Brenner, et al., "Encoded combinatorial chemistry", Proc. Natl. Acad. Sci. USA, 1992, 89:5381-5383.

Carrier, "Inter-regulation of Th17 cytokines and the IL-36 cytokines in vitro and in vivo: implications in psoriasis pathogenesis", Journal of Investigative Dermatology, 2011, 131:2428-2437.

Ciccia, "Interleukin-36α axis is modulated in patients with primary Sjögren's syndrome", Clin Exp Immunol., 2015, 181:230-238.

D'Erme, et al., "IL-36γ (IL-1F9) is a biomarker for psoriasis skin lesions", J Invest Dermatol., 2015, 135(4):1025-1032.

Dall'Acqua, et al., "Properties of human IgG1s engineered for enhanced binding to the neonatal Fc receptor (FcRn)", J Biol Chem., 2006, 281(33):23514-23524.

Ellingford, "A novel mutation in IL36RN underpins childhood pustular dermatosis", J Eur Acad Dermatol Venereol., 2015, 30(2):302-305.

Friedrich, "IL-36γ sustains a proinflammatory self-amplifying loop with IL-17C in anti-TNF-induced psoriasiform skin esions of patients with Crohn's disease", Inflamm Bowel Dis., 2014, 20:1891-1901.

Gabay, "Regulation and function of interleukin-36 cytokines in homeostasis and pathological conditions", Journal of leukocyte biology, 2015, 97(4):645-652.

Ganesan, "Generation and functional characterization of anti-human, anti-mouse IL-36R antagonist mAbs", mAbs, 2017, 9(7):1143-1154.

Garlanda, "The interleukin-1 family: back to the future", Immunity, 2013, 39(6):1003-1018.

Gunther, et al., "Molecular determinants of agonist and antagonist signaling through the IL-36 receptor", J Immunol., 2014, 193:921-930.

He, "IL-36 cytokine expression and its relationship with p38 MAPK and NF-κB pathways in psoriasis vulgaris skin lesions", Journal of Huazhong University of Science and Technology, 2013, 33(4):594-599.

Henry, "Neutrophil-Derived Proteases Escalate Inflammation through Activation of IL-36 Family Cytokines", Cell Reports, 2016, 14:708-722.

Hotzel, et al., "A strategy for risk mitigation of antibodies with fast clearance", mAbs, 2012, 4(6):753-760.

Ichii, et al., "Local overexpression of interleukin-1 family, member 6 relates to the development of tubulointerstitial lesions",. Lab Invest., 2010, 90:459-475.

Kanazawa, "Novel IL36RN mutation in a Japanese case of early onset generalized pustular psoriasis", Journal of Dermatology, 2013, 40(9):749-751.

Kanda, "Interleukin(IL)-36α and IL-36γ Induce Proinflammatory Mediators from Human Colonic Subepithelial Myofibroblasts", Frontiers in Medicine, 2015, 2:69 (9 pages).

Keerman, "Expression of IL-36 family cytokines and IL-37 but not IL-38 is altered in psoriatic skin", J Dermatol Sci, 2015, 80:150-2.

Koenig, et al., "Mutational landscape of antibody variable domains reveals a switch modulating the interdomain conformational dynamics and antigen binding", PNAS, 2017, E486-E495.

Koenig, et al., Deep Sequencing-guided Design of a High Affinity Dual Specificity Antibody to Target Two Angiogenic Factors in Neovascular Age-related Macular Degeneration:, J Biol Chem., 2015, 290(36):21773-21786.

Marrakchi, "Interleukin-36-receptor antagonist deficiency and generalized pustular psoriasis", N Engl J Med, 2011, 365:620-8.

Naik, et al., "Autoinflammatory pustular neutrophilic diseases", Dermatol Clin., 2013, 31(3):405-425.

Nakai, "Acute generalized exanthematous pustulosis caused by dihydrocodeine phosphate in a patient with psoriasis vulgaris and a heterozygous IL36RN mutation", JAMA Dermatol., 2015, 151(3):311-5.

Quaranta, "Intraindividual genome expression analysis reveals a specific molecular signature of psoriasis and eczema", Sci Transl Med., 2014, 244(6):244ra90.

Renert-Yuval, "IL36RN mutation causing generalized pustular psoriasis in a Palestinian patient", International Journal of Dermatology, 2014, 53:866-868.

Ridgway, et al., "'Knobs-into-holes' engineering of antibody CH3 domains for heavy chain heterodimerization", Protein Engineering, 1996, 9(7):617-621.

Shields, et al., "High resolution mapping of the binding site on human IgG1 for Fc gamma RI, Fc gamma RII, Fc gamma RIII, and FcRn and design of IgG1 variants with improved binding to the Fc gamma R", J Biol Chem., 2001, 276(9):6591-604.

Suárez-Fariñas, "RNA sequencing atopic dermatitis transcriptome profiling provides insights into novel disease mechanisms with potential therapeutic implications", J Allergy Clin Immunol, 2015, 135(5):1218-27.

Tortola, et al., "Psoriasiform dermatitis is driven by IL-36-mediated DC-keratinocyte crosstalk", J Clin Invest., 2012, 122(11):3965-3976.

Towne, et al., "IL-36 in psoriasis", Curr Opin Pharmacol., 2012, 12(4):486-90.

Towne, et al., "Interleukin (IL)-1F6, IL-1F8, and IL-1F9 signal through IL-1Rrp2 and IL-1RAcP to activate the pathway leading to NF-kappaB and MAPKs", J Biol Chem., 2004, 279(14):13677-13688.

Towne, et al., "Interleukin-36 (IL-36) Ligands Require Processing for Full Agonist (IL-36a, IL-36b, and IL-36g) or Antagonist (IL-36Ra) Activity", J. Biol. Chem., 2011, 286(49):42594-42602.

Vigne, "IL-36 signaling amplifies Th1 responses by enhancing proliferation and Th1 polarization of naive CD4+ T cells", Blood, 2012,120(17):3478-87.

Vigne, et al., "IL-36R ligands are potent regulators of dendritic and T cells", Blood, 2011, 118(22):5813-5823.

Wang, "Structural insights into the assembly and activation of IL-1β with its receptors", Nature Immunology, 2010, 11 (10):905-911.

Kunkel, Thomas A et al. "Rapid and Efficient Site-Specific Mutagenesis Without Phenotypic Selection." in Methods in Enzymology, Academic Press (1987), vol. 154, pp. 367-382.

* cited by examiner

ANTI-IL-36 ANTIBODIES AND METHODS OF USE THEREOF

FIELD OF THE INVENTION

The present disclosure relates generally to binding proteins, such as antibodies and antigen-binding fragments, which bind to IL-36α, IL-36β, and/or IL-36γ, and methods of using such binding proteins.

REFERENCE TO SEQUENCE LISTING

The official copy of the Sequence Listing is submitted concurrently with the specification as an ASCII formatted text file via EFS-Web, with a file name of "09402-004WO1_SeqList_ST25.txt", a creation date of Dec. 9, 2019, and a size of 1,386,645 bytes. The Sequence Listing filed via EFS-Web is part of the specification and is incorporated in its entirety by reference herein.

BACKGROUND OF THE INVENTION

The interleukin-1 (IL-1) family of cytokine ligands and receptors is associated with inflammation, autoimmunity, immune regulation, cell proliferation, and host defense and contributes to the pathology of inflammatory, autoimmune, immune regulatory, degenerative, and cell proliferative (e.g., cancer) diseases and disorders and its cytokine and receptors serve as pathogenic mediators of such diseases and disorders. See, e.g., Cecilia Garlanda et al., Immunity 39:1003-1018 (2013). The IL-1 family of cytokines includes the pro-inflammatory cytokines, interleukin-36 alpha (IL-36 alpha or IL-36α), interleukin-36 beta (IL-36β or IL-36b), and interleukin-36 gamma (IL-36 gamma or IL-36γ). Each of these IL-36 cytokines serves as a ligand capable of binding to the cognate receptor IL-36R (also referred to as "IL1RL2") that is expressed on the surface of certain cells, including cells of skin, esophagus, tonsil, lung, gut, brain, and immune cells including T cells. Upon binding of an IL-36 cytokine to IL-36R, an accessory protein co-receptor, IL1RAP, is recruited to form a ternary complex comprising the IL-36 cytokine, IL-36R, and IL1 RAP. This ternary complex facilitates intracellular signal transduction and activation of a set of transcription factors, including NF-κB and AP-1, and mitogen-activated protein kinases, which trigger a cascade of inflammatory and immune responses, including the downstream production of numerous cytokines, chemokines, enzymes, and adhesion molecules, including IFN-γ, TNFα, IL-1α, IL-1β, IL-6, IL-8, IL-12, IL-23, CXCL1, CXCL8, and CCL20.

The IL-36 cytokines, IL-36α, IL-36β, and IL-36γ, are known to be highly expressed in several tissues, including skin and internal epithelial tissues that have been exposed to pathogens. For example, expression of IL-36α, IL-36β and IL-36γ is significantly up-regulated in TNF-α-stimulated human keratinocytes (Carrier, et al. (2011) Journal of Investigative Dermatology), and IL-36γ mRNAs are overexpressed in psoriasis skin lesions (D'Erme, et al. (2015) Journal of Investigative Dermatology). Elevated IL-36α mRNA and protein expression also have been observed in chronic kidney disease (Ichii et al, Lab Invest., 90(3): 459-475 (2010)). Additionally, murine bone marrow-derived dendritic cells (BMDCs) and CD4+ T cells respond to IL-36α, IL-36β, and IL-36γ by producing proinflammatory cytokines (e.g., IL-12, IL-1β, IL-6, TNF-α, and IL-23) thereby inducing a proinflammatory effect more potently than other IL-1 cytokines (Vigne et al, Blood, 118(22): 5813-5823 (2011)).

Transgenic mice overexpressing IL-36α in keratinocytes exhibit a transient inflammatory skin disorder at birth that renders mice highly susceptible to a 12-0-tetradecanoylphorbol 13-acetate-induced skin pathology resembling human psoriasis (Blumberg et al, J. Exp. Med., 204(1 1): 2603-2614 (2007); and Blumberg et al, J. Immunol, 755(7):4354-4362 (2010)). Furthermore, IL-36R-deficient mice are protected from imiquimod-induced psoriasiform dermatitis (Tortola et al, J. Clin. Invest., 122(11): 3965-3976 (2012)). These results strongly suggest a role for IL-36 in certain inflammatory disorders of the skin.

IL-36 cytokines are implicated in certain severe forms of psoriasis, including pustular psoriasis, generalized pustular psoriasis (GPP), and palmo-plantar pustulosis (PPP)) (see, e.g., Town, I E. and Sims, I E., Curr. Opin. Pharmacol, 12(4): 486-90 (2012); and Naik, H. B. and Cowen, E. W., Dermatol Clin., 31(3): 405-425 (2013)). Pustular psoriasis is a rare form of psoriasis characterized by white pustules surrounded by red skin. Generalized pustular psoriasis is a severe, systemic form of pustular psoriasis that has a high risk of fatality, while palmo-plantar pustulosis is a chronic form of pustular psoriasis that affects the palms of the hands and soles of the feet. Current treatments for pustular psoriasis, GPP, and PPP include oral retinoids and topical steroids, but these treatments exhibit poor efficacy and severe side effects.

SUMMARY OF THE INVENTION

The present disclosure provides antibodies that specifically bind to IL-36 cytokines with high affinity. The antibodies are capable of decreasing, inhibiting, and/or fully-blocking signaling stimulated by binding of IL-36α, IL-36β, or IL-36γ to their cognate receptor, IL-36R. The present disclosure also provides uses of the anti-IL-36 antibodies in methods of treating IL-36-mediated diseases, such as inflammatory diseases, autoimmune diseases, and cancers including, but not limited to acute generalized exanthematous pustulosis (AGEP), chronic obstructive pulmonary disease (COPD), childhood pustular dermatosis, eczema, generalized pustular psoriasis (GPP), inflammatory bowel disease (IBD), parnoplantar pustular psoriasis (PPP), psoriasis, TNF-induced psoriasis form skin lesions in Crohn's patients, Sjogren's syndrome, and uveitis.

In some embodiments, the present disclosure provides an anti-IL-36 antibody comprising (i) a first light chain hypervariable region (HVR-L1), a second light chain hypervariable region (HVR-L2), and a third light chain hypervariable region (HVR-L3), and/or (ii) a first heavy chain hypervariable region (HVR-H1), a second heavy chain hypervariable region (HVR-H2), and a third heavy chain hypervariable region (HVR-H3), wherein:
  (a) HVR-L1 comprises an amino acid sequence selected from TGSSSNIGAHYDVH (SEQ ID NO: 18), TGSSSNIGAGYDVH (SEQ ID NO: 22), RASQSVSSNYLA (SEQ ID NO: 38), or RASQTIYKYLN (SEQ ID NO: 42);
  (b) HVR-L2 comprises an amino acid sequence selected from SNNNRPS (SEQ ID NO: 15), GNDNRPS (SEQ ID NO: 19), GNTNRPS (SEQ ID NO: 23), GNRNRPS (SEQ ID NO: 27), SASSLQS (SEQ ID NO: 39), or AASSLQS (SEQ ID NO: 43);
  (c) HVR-L3 comprises an amino acid sequence selected from QSYDYSLRGYV (SEQ ID NO: 16), QSYDYSLSGYV (SEQ ID NO: 20), QSYDYSLRVYV (SEQ ID NO: 28), QSYDYSLKAYV (SEQ ID NO: 32), QSYDISLSGWV (SEQ ID NO: 36), QQTYSYPPT (SEQ ID NO: 40), or QQSSIPYT (SEQ ID NO: 44);

(d) HVR-H1 comprises an amino acid sequence selected from SAYAMHW (SEQ ID NO: 46), STSSYYW (SEQ ID NO: 50), SSTSYYW (SEQ ID NO: 54), GSRSYYW (SEQ ID NO: 58), STYAMSW (SEQ ID NO: 62), TSSNYYW (SEQ ID NO: 66), SSYGMH (SEQ ID NO: 70), SNYAIS (SEQ ID NO: 74), TSTNYYW (SEQ ID NO: 82), TSSNAYW (SEQ ID NO: 86), TASNYYW (SEQ ID NO: 90), TASNTYW (SEQ ID NO: 106), SDSSYYW (SEQ ID NO: 122), SESSYYW (SEQ ID NO: 126), STSSDYW (SEQ ID NO: 130), SNSSYYW (SEQ ID NO: 134), STSSYHW (SEQ ID NO: 142), SRSSYYW (SEQ ID NO: 146), XXXNXYX (SEQ ID NO: 251) wherein X at position 1 is T, D, E, or N; X at position 2 is S, A, E, G, K, Q, R, or T; X at position 3 is S, A, D, E, G, N, P, Q, or T; X at position 5 is Y, A, E, G, H, M, N, Q, S, T, or V; X at position 7 is W, F, I, V, or Y, or XXXXXXW (SEQ ID NO: 336) wherein X at position 1 is S or D; X at position 2 is T, A, D, E, G, H, K, N, P, Q, R, or S; X at position 3 is S, D, E, G, K, N, P, or R; X at position 4 is S, G, K, N, or P; X at position 5 is Y, A, D, E, G, H, M, N, Q, S, T, V, or W; X at position 6 is Y, A, F, G, H, M, N, or Q;

(e) HVR-H2 comprises an amino acid sequence selected from VISYDGTNEYYAD (SEQ ID NO: 47), SIYYTGNTYYNP (SEQ ID NO: 51), SIHYSGNTYYNP (SEQ ID NO: 55), SIHYSGTTYYNP (SEQ ID NO: 59), GISGGSGYTYYAD (SEQ ID NO: 63), SIDYTGSTYYNP (SEQ ID NO: 67), VISYGGSERYYAD (SEQ ID NO: 71), GILPILGTVDYAQ (SEQ ID NO: 75), NIDYTGSTYYNA (SEQ ID NO: 83), SIDYTGSTAYNP (SEQ ID NO: 87), SIDYTGSTYYNT (SEQ ID NO: 91), SIDYTGSTYYEP (SEQ ID NO: 99), SIDYTGSTYYEP (SEQ ID NO: 103), SIDYTGSTYYQP (SEQ ID NO: 119), SIYYTGNTYYNS (SEQ ID NO: 123), SIYYTGNTYYLP (SEQ ID NO: 131), SIYYTGNTYYMP (SEQ ID NO: 143), SIYYTGNTYYWP (SEQ ID NO: 147), SIYYTGETYYAP (SEQ ID NO: 151), XXDXXXXXXYXX (SEQ ID NO: 284) wherein X at position 1 is S, N, or T; X at position 2 is I, M, or V; X at position 4 is Y, or H; X at position 5 is T, H, L, or N; X at position 6 is G, A, D, E, H, K, N, Q, R, S, or T; X at position 7 is S, A, D, Q, or T; X at position 8 is T, A, D, or E; X at position 9 is Y, A, F, Q, S, or W; X at position 11 is N, D, E, H, P, or Q; X at position 12 is P, A, or E, or XXXXXXXXXYXP (SEQ ID NO: 379) wherein X at position 1 is S, F, I, M, or Q; X at position 2 is I, A, G, L, R, S, T, or V; X at position 3 is Y, A, D, E, F, G, H, K, L, M, N, P, Q, R, S, T, or W; X at position 4 is Y, A, D, E, F, G, H, K, N, P, Q, R, S, T, or W; X at position 5 is T, D, E, K, N, P, or Q; X at position 6 is G or Q; X at position 7 is N, D, E, G, H, I, K, M, P, R, or S; X at position 8 is T, A, E, F, G, H, K, P, Q, R, S, V, W, or Y; X at position 9 is Y or W; X at position 11 is N, A, D, E, K, L, M, P, Q, S or T;

(f) HVR-H3 comprises an amino acid sequence selected from ARGIRIFTSYFDS (SEQ ID NO: 48), ARVRYGVGVPRYFDP (SEQ ID NO: 52), ARVHYGGYIPRRFDH (SEQ ID NO: 56), ARVAPSYPRVFDY (SEQ ID NO: 60), ARVVTYRDPPASFDY (SEQ ID NO: 64), ARGKYYETYLGFDV (SEQ ID NO: 68), AREPWYSSRGWTGYGFDV (SEQ ID NO: 72), AREPWYRLGAFDV (SEQ ID NO: 76), ATGKYYETYLGFDV (SEQ ID NO: 84), AHGKYYETYLGFDV (SEQ ID NO: 88), ATGSYYETYLGFDV (SEQ ID NO: 100), ATGNYYETYLGFDV (SEQ ID NO: 104), ASGKYYETYLGFDV (SEQ ID NO: 112), ARGNYYETYLGFDV (SEQ ID NO: 120), AGVRYGVGVPRYFDP (SEQ ID NO: 128), SRVRYGVGVPRYFDP (SEQ ID NO: 132), VRVRYGVGVPRYFDP (SEQ ID NO: 144), TRVRYGVGVPRYFDP (SEQ ID NO: 148), ARLRYGVGVPRYFDP (SEQ ID NO: 152), ARVKYGVGVPRYFDP (SEQ ID NO: 156), ARVRYGVGVPRHFDP (SEQ ID NO: 160), AXGXYYXTYLGFDV (SEQ ID NO: 322) wherein X at position 2 is R, A, E, G, H, M, N, Q, S, T, or Y; X at position 4 is K, A, or S; X at position 7 is E or T, or XXXXXGXXVPRXFDP (SEQ ID NO: 462) wherein X at position 1 is A or V; X at position 2 is R, A, G, N, Q, or T; X at position 3 is V, A, F, I, K, L, M, Q, or S; X at position 4 is R, A, I, K, L, M, P, Q, S, T, or V; X at position 5 is Y, H, I, L, or V; X at position 7 is V, A, F, G, K, M, N, Q, R, S, T, W, or Y; X at position 8 is G, N, R, S, or T; X at position 12 is Y, F, H, I, L, M, Q, or R.

In some embodiments, the anti-IL-36 antibody comprises:
(a) HVR-L1 comprising the amino acid sequence of SEQ ID NO: 18;
(b) HVR-L2 comprising the amino acid sequence of SEQ ID NO: 19; and
(c) HVR-L3 comprising the amino acid sequence of SEQ ID NO: 20.

In some embodiments, the anti-IL-36 antibody comprises:
(d) HVR-H1 comprises the amino acid sequence selected from SEQ ID NO: 66, 82, 86, 90, or 252-283;
(e) HVR-H2 comprises the amino acid sequence selected from SEQ ID NO: 67, 83, 87, 91, 99, 103, 119, or 285-321; and
(f) HVR-H3 comprises the amino acid sequence selected from SEQ ID NO: 68, 84, 88, 100, 104, 112, 120, or 323-335.

In some embodiments, the anti-IL-36 antibody comprises:
(d) HVR-H1 comprises an amino acid sequence selected from SEQ ID NO: 50, 122, 126, 130, 134, 138, 142, 146, or 337-378;
(e) HVR-H2 comprises an amino acid sequence selected from SEQ ID NO: 51, 123, 131, 143, 147, 151, or 380-461; and
(f) HVR-H3 comprises an amino acid sequence selected from SEQ ID NO: 52, 128, 132, 144, 148, 152, 156, 160, or 463-513.

In some embodiments, the anti-IL-36 antibody comprises:
(a) HVR-L1 comprises the amino acid sequence of SEQ ID NO: 18;
(b) HVR-L2 comprises the amino acid sequence of SEQ ID NO: 19;
(c) HVR-L3 comprises the amino acid sequence of SEQ ID NO: 20;
(d) HVR-H1 comprises the amino acid sequence selected from SEQ ID NO: 66, 82, 86, 90, or 252-283;
(e) HVR-H2 comprises the amino acid sequence selected from SEQ ID NO: 67, 83, 87, 91, 99, 103, 119, or 285-321; and
(f) HVR-H3 comprises the amino acid sequence selected from SEQ ID NO: 68, 84, 88, 100, 104, 112, 120, or 323-335.

In some embodiments, the anti-IL-36 antibody comprises:
(a) HVR-L1 comprises the amino acid sequence of SEQ ID NO: 18;
(b) HVR-L2 comprises the amino acid sequence of SEQ ID NO: 19;

(c) HVR-L3 comprises the amino acid sequence of SEQ ID NO: 20;

(d) HVR-H1 comprises an amino acid sequence selected from SEQ ID NO: 50, 122, 126, 130, 134, 138, 142, 146, or 337-378;

(e) HVR-H2 comprises an amino acid sequence selected from SEQ ID NO: 51, 123, 131, 143, 147, 151, or 380-461; and (f) HVR-H3 comprises an amino acid sequence selected from SEQ ID NO: 52, 128, 132, 144, 148, 152, 156, 160, or 463-513.

In some embodiments, the anti-IL-36 antibody comprises a light chain variable domain ($V_L$) amino acid sequence having at least 90% identity to a sequence selected from SEQ ID NO: 13, 17, 21, 25, 29, 33, 37, 41, 77, or 78; and/or a heavy chain variable domain ($V_H$) amino acid sequence having at least 90% identity to a sequence selected from SEQ ID NO: 45, 49, 53, 57, 61, 65, 69, 73, 79, 80, 81, 85, 89, 93, 97, 101, 105, 109, 113, 117, 121, 125, 129, 133, 137, 141, 145, 149, 153, 157, 161, or 165. In some embodiments, the anti-IL-36 antibody comprises a light chain variable domain ($V_L$) amino acid sequence selected from SEQ ID NO: 13, 17, 21, 25, 29, 33, 37, 41, 77, or 78; and/or a heavy chain variable domain ($V_H$) amino acid sequence selected from SEQ ID NO: 45, 49, 53, 57, 61, 65, 69, 73, 79, 80, 81, 85, 89, 93, 97, 101, 105, 109, 113, 117, 121, 125, 129, 133, 137, 141, 145, 149, 153, 157, 161, or 165.

In some embodiments, the anti-IL-36 antibody comprises a light chain variable domain ($V_L$) amino acid sequence having at least 90% identity to SEQ ID NO: 17 or 77; and/or a heavy chain variable domain ($V_H$) amino acid sequence having at least 90% identity to a sequence selected from SEQ ID NO: 49, 65, 79, 80, 81, 85, 89, 93, 97, 101, 105, 109, 113, 117, 121, 125, 129, 133, 137, 141, 145, 149, 153, 157, 161, or 165. In some embodiments, the anti-IL-36 antibody comprises a light chain variable domain ($V_L$) amino acid sequence of SEQ ID NO: 17 or 77; and/or a heavy chain variable domain ($V_H$) amino acid sequence selected from SEQ ID NO: 49, 65, 79, 80, 81, 85, 89, 93, 97, 101, 105, 109, 113, 117, 121, 125, 129, 133, 137, 141, 145, 149, 153, 157, 161, or 165.

In some embodiments, the anti-IL-36 antibody comprises a light chain variable domain ($V_L$) amino acid sequence having at least 90% identity to SEQ ID NO: 17 or 77; and/or a heavy chain variable domain ($V_H$) amino acid sequence having at least 90% identity to a sequence selected from SEQ ID NO: 65, 80, 81, 85, 89, 93, 97, 101, 105, 109, 113, or 117. In some embodiments, the anti-IL-36 antibody comprises a light chain variable domain ($V_L$) amino acid sequence of SEQ ID NO: 17 or 77; and/or a heavy chain variable domain ($V_H$) amino acid sequence selected from SEQ ID NO: 65, 80, 81, 85, 89, 93, 97, 101, 105, 109, 113, or 117.

In some embodiments, the anti-IL-36 antibody comprises a light chain variable domain ($V_L$) amino acid sequence having at least 90% identity to SEQ ID NO: 17 or 77; and/or a heavy chain variable domain ($V_H$) amino acid sequence having at least 90% identity to a sequence selected from SEQ ID NO: 49, 79, 121, 125, 129, 133, 137, 141, 145, 149, 153, 157, 161, or 165. In some embodiments, the anti-IL-36 antibody comprises a light chain variable domain ($V_L$) amino acid sequence of SEQ ID NO: 17 or 77; and/or a heavy chain variable domain ($V_H$) amino acid sequence selected from SEQ ID NO: 49, 79, 121, 125, 129, 133, 137, 141, 145, 149, 153, 157, 161, or 165.

In some embodiments, the anti-IL-36 antibody comprises a light chain (LC) amino acid sequence having at least 90% identity to SEQ ID NO: 169 or 242; and/or a heavy chain (HC) amino acid sequence having at least 90% identity to a sequence selected from SEQ ID NO: 170-202, 248, 249, or 250. In some embodiments, the anti-IL-36 antibody comprises a light chain (LC) amino acid sequence of SEQ ID NO: 169 or 242; and/or a heavy chain (HC) amino acid sequence selected from SEQ ID NO: 170-202, 248, 249, or 250.

In some embodiments, the anti-IL-36 antibody comprises a light chain (LC) amino acid sequence having at least 90% identity to SEQ ID NO: 169 or 242; and/or a heavy chain (HC) amino acid sequence having at least 90% identity to a sequence selected from SEQ ID NO: 518-616, and 743-751. In some embodiments, the anti-IL-36 antibody comprises a light chain (LC) amino acid sequence of SEQ ID NO: 169 or 242; and/or a heavy chain (HC) amino acid sequence of SEQ ID NO: 518-616, and 743-751.

In some embodiments, the anti-IL-36 antibody comprises a light chain (LC) amino acid sequence having at least 90% identity to SEQ ID NO: 169 or 242; and/or a heavy chain (HC) amino acid sequence having at least 90% identity to a sequence selected from SEQ ID NO: 203-241. In some embodiments, the anti-IL-36 antibody comprises a light chain (LC) amino acid sequence having of SEQ ID NO: 169 or 242; and/or a heavy chain (HC) amino acid sequence selected from SEQ ID NO: 203-241.

In some embodiments, the anti-IL-36 antibody comprises a light chain (LC) amino acid sequence having at least 90% identity to SEQ ID NO: 169 or 242; and/or a heavy chain (HC) amino acid sequence having at least 90% identity to a sequence selected from SEQ ID NO: 617-733. In some embodiments, the anti-IL-36 antibody comprises a light chain (LC) amino acid sequence having of SEQ ID NO: 169 or 242; and/or a heavy chain (HC) amino acid sequence selected from SEQ ID NO: 617-733.

In some embodiments, the present disclosure provides an anti-IL-36 antibody wherein the antibody is a multispecific antibody comprising:

(a) a pair of light chains each comprising: HVR-L1 sequence of SEQ ID NO: 18; HVR-L2 sequence of SEQ ID NO: 19; and HVR-L3 sequence of SEQ ID NO: 20;

(b) a heavy chain comprising: HVR-H1 sequence selected from SEQ ID NOs: 66, 82, 86, 90, or 106; HVR-H2 sequence selected from SEQ ID NOs: 67, 83, 87, 91, 99, 103, or 119; and HVR-H3 sequence selected from SEQ ID NOs: 68, 84, 88, 100, 104, 112, or 120; and (c) a heavy chain comprising: HVR-H1 sequence selected from SEQ ID NOs: 50, 122, 126, 130, 134, 142, or 146; HVR-H2 sequence selected from SEQ ID NOs: 51, 123, 127, 131, 135, 139, 143, 147, or 151; and HVR-H3 comprises an amino acid sequence selected from SEQ ID NOs: 52, 128, 132, 144, 148, 152, 156, or 160.

In some embodiments, the multispecific antibody comprises: one of the heavy chains comprising an amino acid substitution T366W, and the other heavy chain comprising amino acid substitutions T366S, L368A and Y407V.

In some embodiments, the multispecific antibody comprises:

(a) a pair of light chains each comprising a light chain variable domain ($V_L$) amino acid sequence of SEQ ID NO: 17 or 77;

(b) a heavy chain comprising a heavy chain variable domain (V$_H$) amino acid sequence selected from SEQ ID NO: 65, 80, 81, 85, 89, 93, 97, 101, 105, 109, 113, or 117; and
(c) a heavy chain comprising a heavy chain variable domain (V$_H$) amino acid sequence selected from SEQ ID NO: 49, 79, 121, 125, 129, 133, 137, 141, 145, 149, 153, 157, 161, or 165.

In some embodiments, the multispecific antibody comprises:
(a) a pair of light chain (LC) amino acid sequences of SEQ ID NO: 169 and 242;
(b) a heavy chain (HC) amino acid sequence selected from SEQ ID NO: 171, 174,177, 180, 183, 186, 189, 192, 195, 198, 201, 249, 521, 522, 523, 530, 531, 532, 539, 540, 541, 548, 549, 550, 557, 558, 559, 566, 567, 568, 575, 576, 577, 584, 585, 586, 593, 594, 595, 602, 603, 604, 611, 612, and 613; and
(c) a heavy chain (HC) amino acid sequence selected from SEQ ID NO: 208, 211, 214, 217, 220, 223, 226, 229, 232, 235, 238, 241, 632, 633, 634, 641, 642, 643, 650, 651, 652, 659, 660, 661, 668, 669, 670, 677, 678, 679, 686, 687, 688, 695, 696, 697, 704, 705, 706, 713, 714, 715, 722, 723, 724, 731, 732, and 733.

In some embodiments, the multispecific antibody comprises:
(a) a pair of light chain (LC) amino acid sequences of SEQ ID NO: 169 and 242;
(b) a heavy chain (HC) amino acid sequence selected from SEQ ID NO: 172, 175, 178, 181, 184, 187, 190, 193, 196, 199, 202, 250, 524, 525, 526, 533, 534, 535, 542, 543, 544, 551, 552, 553, 560, 561, 562, 569, 570, 571, 578, 579, 580, 587, 588, 589, 596, 597, 598, 605, 606, 607, 614, 615, 616, 749, 750, and 751; and
(c) a heavy chain (HC) amino acid sequence selected from SEQ ID NO: 207, 210, 213, 216, 219, 222, 225, 228, 231, 234, 237, 240, 629, 630, 631, 638, 639, 640, 647, 648, 649, 656, 657, 658, 665, 666, 667, 674, 675, 676, 683, 684, 685, 692, 693, 694, 701, 702, 703, 710, 711, 712, 719, 720, 721, 728, 729, and 730.

In some embodiments, the present disclosure provides a multispecific anti-IL-36 antibody, wherein the antibody comprises a pair of light chain (LC) amino acid sequences of SEQ ID NO: 169; a heavy chain (HC) amino acid sequence selected from SEQ ID NO: 192, 584, 585, and 586; and a heavy chain (HC) amino acid sequence selected from SEQ ID NO: 235, 713, 714, and 715.

In various embodiments of the anti-IL-36 antibodies provided by the present disclosure, the antibody is characterized by one or more of the following properties:
(a) binds to hu-IL-36α, hu-IL-36-β, and/or hu-IL-36-γ with a binding affinity of $1\times10^{-8}$ M or less, $1\times10^{-9}$ M or less, $1\times10^{-10}$ M or less, or $1\times10^{-11}$ M or less; optionally, wherein the antibody is multispecific;
(b) binds to hu-IL-36α and hu-IL-36-γ with a binding affinity of $1\times10^{-8}$ M or less, $1\times10^{-9}$ M or less, $1\times10^{-10}$ M or less, or $1\times10^{-11}$ M or less;
(c) binds to hu-IL-36-β with a binding affinity of $1\times10^{-8}$ M or less, $1\times10^{-9}$ M or less, $1\times10^{-10}$ M or less, or $1\times10^{-11}$ M or less;
(d) is multispecific and comprises a specificity for IL-36α and/or IL-36γ in one arm, and a specificity for IL-36β in the other arm; optionally, wherein one arm binds to hu-IL-36α and hu-IL-36-γ with a binding affinity of $1\times10^{-8}$ M or less, $1\times10^{-9}$ M or less, $1\times10^{-10}$ M or less, or $1\times10^{-11}$ M or less, and the other arm binds to hu-IL-36-β with a binding affinity of $1\times10^{-8}$ M or less, $1\times10^{-9}$ M or less, $1\times10^{-10}$ M or less, or $1\times10^{-11}$ M or less;
(e) decreases an intracellular signal stimulated by IL-36α, IL-36β, and/or IL-36γ by at least 90%, at least 95%, at least 99%, or 100%; optionally, wherein at an IL-36α, IL-36β, and/or IL-36γ concentration of about EC$_{50}$ the antibody has an IC$_{50}$ of 10 nM or less, 5 nM or less, or 1 nM or less; optionally, wherein the antibody is multispecific;
(f) inhibits release of IL-8 from primary human keratinocytes (PHKs) stimulated by IL-36α, IL-36β, and/or IL-36γ, optionally, wherein at an IL-36α, IL-36β, and/or IL-36γ concentration of about EC$_{50}$ the antibody has an IC$_{50}$ of 10 nM or less, 5 nM or less, or 1 nM or less; optionally, wherein the antibody is multispecific; and/or
(g) cross-reacts with an IL-36α, IL-36β, or IL-36γ of cynomolgus monkey of SEQ ID NO: 5, 6, or 7; optionally, wherein the antibody is multispecific.

The present disclosure also provides embodiments of the anti-IL-36 antibody, wherein: (i) the antibody is a monoclonal antibody; (ii) the antibody is a human, humanized, or chimeric antibody; (iii) the antibody is a full length antibody of class IgG, optionally, wherein the class IgG antibody has an isotype selected from IgG1, IgG2, IgG3, and IgG4; (iv) the antibody is an Fc region variant, optionally an Fc region variant that alters effector function (e.g., a variant resulting in an effectoriess antibody), or an Fc region variant the alters antibody half-life; (v) the antibody is an antibody fragment, optionally selected from the group consisting of F(ab')$_2$, Fab', Fab, Fv, single domain antibody (VHH), and scFv; (vi) the antibody is an immunoconjugate, optionally, wherein the immunoconjugate comprises a therapeutic agent for treatment of an IL-36-mediated disease; (vii) the antibody is a multi-specific antibody, optionally a multispecific antibody; and (viii) the antibody is a synthetic antibody, wherein the HVRs are grafted onto a scaffold or framework other than an immunoglobulin scaffold or framework; optionally, a scaffold selected from an alternative protein scaffold and an artificial polymer scaffold.

In other embodiments, the present disclosure provides isolated nucleic acids encoding the anti-IL-36 antibodies disclosed herein. In some embodiments, the present disclosure also provides a host cell comprising a nucleic acid encoding an anti-IL-36 antibody as disclosed herein. The disclosure also provides a method of producing an anti-IL-36 antibody, wherein the method comprises culturing a host cell comprising a nucleic acid (or vector) encoding an anti-IL-36 antibody so that an antibody is produced.

In some embodiments, the disclosure provides a pharmaceutical composition comprising an anti-IL-36 antibody as disclosed herein and a pharmaceutically acceptable carrier. In some embodiments, the pharmaceutical composition comprises an anti-IL-36 antibody as the sole active agent; optionally, wherein the anti-IL-36 antibody is a multispecific antibody comprising a specificity for IL-36α and/or IL-36γ in one arm, and a specificity for IL-36β in the other arm. In some embodiments, the pharmaceutical composition further comprises a therapeutic agent for treatment of an IL-36-mediated disease or condition.

In some embodiments, the present disclosure provides a method of treating an IL-36-mediated disease or condition in a subject, comprising administering to the subject a therapeutically effective amount of an anti-IL-36 antibody as disclosed herein, or a therapeutically effective amount of a pharmaceutical composition of an anti-IL-36 antibody as disclosed herein. In some embodiments, the uses and methods of treatment comprise administering a pharmaceutical composition comprising an anti-IL-36 antibody as the sole active agent; optionally, wherein the anti-IL-36 antibody is a multispecific antibody comprising a specificity for IL-36α and/or IL-36γ in one arm, and a specificity for IL-36β in the other arm.

In some embodiments of the uses and methods of treatment disclosed herein, the IL-36-mediated disease is selected from an inflammatory disease, an autoimmune disease, and a cancer. In some embodiments, the IL-36-mediated disease is selected from: acne due to epidermal growth factor receptor inhibitors, acne and suppurative hidradenitis (PASH), acute generalized exanthematous pustulosis (AGEP), amicrobial pustulosis of the folds, amicrobial pustulosis of the scalp/leg, amicrobial subcorneal pustulosis, aseptic abscess syndrome, Behçet's disease, bowel bypass syndrome, chronic obstructive pulmonary disease (COPD), childhood pustular dermatosis, Crohn's disease, deficiency of the interleukin-1 receptor antagonist (DIRA), deficiency of interleukin-36 receptor antagonist (DITRA), eczema, generalized pustular psoriasis (GPP), erythema elevatum diutinum, hidradenitis suppurativa, IgA pemphigus, inflammatory bowel disease (IBD), neutrophilic panniculitis, palmoplantar pustular psoriasis (PPP), psoriasis, psoriatic arthritis, pustular psoriasis (DIRA, DITRA), pyoderma gangrenosum, pyogenic arthritis pyoderma gangrenosum and acne (PAPA), pyogenic arthritis pyoderma gangrenosum acne and suppurative hidradenitis (PAPASH), rheumatoid neutrophilic dermatosis, synovitis acne pustulosis hyperostosis and osteitis (SAPHO), TNF-induced psoriasis form skin lesions in Crohn's patients, Sjogren's syndrome, Sweet's syndrome, systemic lupus erythematosus (SLE), ulcerative colitis, and uveitis. In some embodiments, the IL-36-mediated disease is selected from generalized pustular psoriasis (GPP), palmoplantar pustular psoriasis (PPP), and psoriasis. In some embodiments, the IL-36-mediated disease is a cancer; optionally, a cancer selected from breast cancer, colorectal cancer, non-small cell lung cancer, and pancreatic cancer.

BRIEF DESCRIPTION OF THE FIGURES

FIG. 1A: mAb2.0 inhibition of IL-36α stimulation ([IL-36α]=1.2 nM) of HaCat cells; $IC_{50}$=0.28 nM. FIG. 1B: mAb6.0 inhibition of IL-36β stimulation ([IL-36β]=0.175 nM) of HaCat cells; $IC_{50}$-0.082 nM. FIG. 1C: mAb2.0 inhibition of IL-36γ stimulation ([IL-36γ]=4 nM) of HaCat cells; $IC_{50}$=1.23 nM. All assays were performed at an agonist concentration of about $EC_{50}$; error bars shown are representative of the standard deviation from duplicate samples. The negative control (NC, shown as a grey, dotted line), represents cells exposed to growth medium only, while the positive control (PC, shown as a grey, dashed line) represents cells exposed to the agonist only (in the absence of antagonistic or control antibodies).

FIG. 2A: mAb2.0 inhibition of IL-36α stimulation ([IL-36α]=1.2 nM) of HEKn cells; $IC_{50}$=0.33 nM. FIG. 2B: mAb6.0 inhibition of IL-36β stimulation ([IL-36β]=0.3 nM) of HEKn cells; $IC_{50}$-1.75 nM. FIG. 2C: mAb2.0 inhibition of IL-36γ stimulation ([IL-36γ]=7 nM) of HEKn cells; $IC_{50}$=2.27 nM. All assays were performed at an agonist concentration of about $EC_{50}$; error bars shown are representative of the standard deviation from duplicate samples. The negative control (NC, shown as a grey, dotted line), represents cells exposed to growth medium only, while the positive control (PC, shown as a grey, dashed line) represents cells exposed to the agonist only (in the absence of antagonistic or control antibodies).

FIG. 3A: mAb2.10/mAb6_2.7 inhibition of IL-36α stimulation ([IL-36α]=0.8 nM) of HaCat cells; $IC_{50}$=0.38 nM. FIG. 3B: mAb2.10/mAb6_2.7 inhibition of IL-36β stimulation ([IL-36β]=0.15 nM) of HaCat cells; $IC_{50}$=0.13 nM. FIG. 3C: mAb2.10/mAb6_2.7 inhibition of IL-36γ stimulation ([IL-36γ]=2 nM) of HaCat cells; $IC_{50}$=1.1 nM. All assays were performed at an agonist concentration of about $EC_{50}$; error bars shown are representative of the standard deviation from duplicate samples. The negative control (NC, shown as a grey, dotted line), represents cells exposed to growth medium only, while the positive control (PC, shown as a grey, dashed line) represents cells exposed to the agonist only (in the absence of antagonistic or control antibodies).

FIG. 4A: mAb2.10/mAb6_2.7 inhibition of IL-36α stimulation ([IL-36α]=1.1 nM) of HEKa cells; $IC_{50}$=0.56 nM. FIG. 4B: mAb2.10/mAb6_2.7 inhibition of IL-36β stimulation ([IL-36β]=0.15 nM) of HEKa cells; $IC_{50}$=0.11 nM. FIG. 4C: mAb2.10/mAb6_2.7 inhibition of IL-36γ stimulation ([IL-36γ]=3.6 nM) of HEKa cells; $IC_{50}$=2.7 nM. All assays were performed at an agonist concentration of about $EC_{50}$; error bars shown are representative of the standard deviation from duplicate samples. The negative control (NC, shown as a grey, dotted line), represents cells exposed to growth medium only, while the positive control (PC, shown as a grey, dashed line) represents cells exposed to the agonist only (in the absence of antagonistic or control antibodies).

DETAILED DESCRIPTION

Figure 1A:
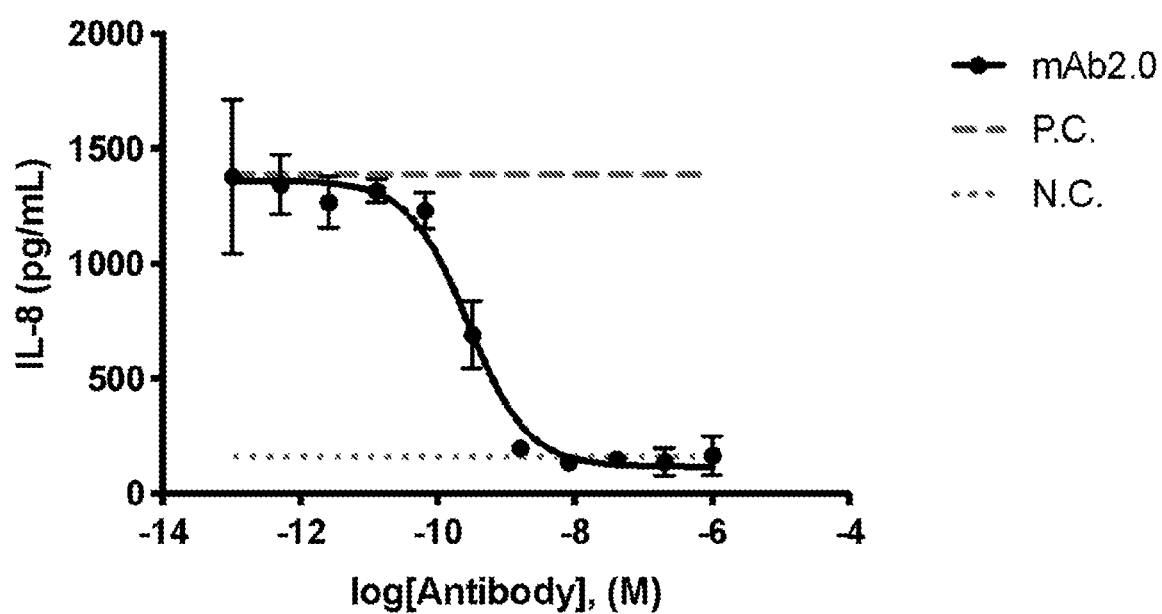
FIG. 1A, FIG. 1B, and FIG. 1C depict plots of results for the yeast display-derived anti-hu-IL-36 antibodies mAb2.0 and mAb6.0 in inhibition assays of IL-36-stimulated intracellular signaling in the HaCat human keratinocyte cell line.

The present disclosure provides antibodies, including multispecific antibodies, that specifically bind human the hu-IL-36 cytokines, IL-36α, IL-36β, and IL-36γ with high affinity. The disclosed anti-IL-36 antibodies are capable of decreasing, inhibiting, and/or fully-blocking intracellular signaling by IL-36-mediated pathways, including signaling stimulated by binding of IL-36α, IL-36β, or IL-36γ to its cognate receptor, IL-36R. The present disclosure also provides uses of the anti-IL-36 antibodies in methods of treating IL-36-mediated diseases, such as inflammatory diseases, autoimmune diseases, and cancers, specifically including, but not limited to acute generalized exanthematous pustulosis (AGEP), chronic obstructive pulmonary disease (COPD), childhood pustular dermatosis, eczema, generalized pustular psoriasis (GPP), inflammatory bowel disease (IBD), palmoplantar pustular psoriasis (PPP), psoriasis, TNF-induced psoriasis form skin lesions in Crohn's patients, Sjogren's syndrome, uveitis.

Overview of Terminology and Technique

For the descriptions herein and the appended claims, the singular forms "a", and "an" include plural referents unless the context clearly indicates otherwise. Thus, for example, reference to "a protein" includes more than one protein, and reference to "a compound" refers to more than one compound. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation. The use of "comprise," "comprises," "comprising" "include," "includes," and "including" are interchangeable and not intended to be limiting. It is to be further understood that where descriptions of various embodiments use the term "comprising," those skilled in the art would understand that in some specific instances, an embodiment can be alternatively described using language "consisting essentially of" or "consisting of."

Where a range of values is provided, unless the context clearly dictates otherwise, it is understood that each intervening integer of the value, and each tenth of each intervening integer of the value, unless the context clearly dictates otherwise, between the upper and lower limit of that range, and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of these limits, ranges excluding (i) either or (ii) both of those included limits are also included in the invention. For example, "1 to 50," includes "2 to 25," "5 to 20," "25 to 50," "1 to 10," etc.

Generally, the nomenclature used herein and the techniques and procedures described herein include those that are well understood and commonly employed by those of ordinary skill in the art, such as the common techniques and methodologies described in Sambrook et al., *Molecular Cloning—A Laboratory Manual* (2nd Ed.), Vols. 1-3, Cold Spring Harbor Laboratory, Cold Spring Harbor, N.Y., 1989 (hereinafter "Sambrook"); *Current Protocols in Molecular Biology*, F. M. Ausubel et al., eds., Current Protocols, a joint venture between Greene Publishing Associates, Inc. and John Wiley & Sons, Inc. (supplemented through 2011) (hereinafter "Ausubel"); *Antibody Engineering*, Vols. 1 and 2, R. Kontermann and S. Dubel, eds., Springer-Verlag, Berlin and Heidelberg (2010); *Monoclonal Antibodies: Methods and Protocols*, V. Ossipow and N. Fischer, eds., 2nd Ed., Humana Press (2014); *Therapeutics Antibodies: From Bench to Clinic*, Z. An, ed., J. Wiley & Sons, Hoboken, N.J. (2009); and *Phage Display*, Tim Clackson and Henry B. Lowman, eds., Oxford University Press, United Kingdom (2004).

All publications, patents, patent applications, and other documents referenced in this disclosure are hereby incorporated by reference in their entireties for all purposes to the same extent as if each individual publication, patent, patent application or other document were individually indicated to be incorporated by reference herein for all purposes.

Unless defined otherwise, all technical and scientific terms used herein have the same meaning as commonly understood by one of ordinary skill in the art to which the present invention pertains. It is to be understood that the terminology used herein is for describing particular embodiments only and is not intended to be limiting. For purposes of interpreting this disclosure, the following description of terms will apply and, where appropriate, a term used in the singular form will also include the plural form and vice versa.

"IL-36," as used herein, refers to the interleukin-36 cytokines IL-36α, IL-36β, and IL-36γ, collectively.

"IL-36α" or "IL-36a" as used herein, refers to the interleukin-36α cytokine from any species in which it occurs. "hu-IL-36α" and "cy-IL-36α" refer to the IL-36α cytokine from humans and cynomolgus monkey, respectively.

"IL-36β" or "IL-36b" as used herein, refers to the interleukin-36β cytokine from any species in which it occurs. "hu-IL-36β" and "cy-IL-36β" refer to the IL-36β cytokine from humans and cynomolgus monkey, respectively.

"IL-36γ" or "IL-36g" as used herein, refers to the interleukin-36γ cytokine from any species in which it occurs. "hu-IL-36γ" and "cy-IL-36γ" refer to the IL-36γ cytokine from humans and cynomolgus monkey, respectively.

"IL-36 mediated condition" or "IL-36 mediated disease," as used herein, encompasses any medical condition associated with aberrant function of the signaling pathways mediated by binding of any of the IL-36 cytokines, IL-36α, IL-36β, and IL-36γ, to their cognate receptor IL-36R, including but not limited to, the downstream pathways known to be stimulated by the IL-36 cytokines that result in the production of cytokines, chemokines, enzymes, and adhesion molecules, including but not limited to IFN-γ, TNFα, IL-1α, IL-1s, IL-6, IL-8, IL-12, IL-23, CXCL1, CXCL8, and CCL20. For example, IL-36 mediated diseases can include, but are not limited to, diseases mediated by and/or responsive to antagonists or inhibitors of the IL-36 signaling pathways including inflammatory diseases, autoimmune diseases, and cancers. More specifically, IL-36 mediated diseases can include but are not limited to acne due to epidermal growth factor receptor inhibitors, acne and suppurative hidradenitis (PASH), acute generalized exanthematous pustulosis (AGEP), amicrobial pustulosis of the folds, amicrobial pustulosis of the scalp/leg, amicrobial subcorneal pustulosis, aseptic abscess syndrome, Behçet's disease, bowel bypass syndrome, chronic obstructive pulmonary disease (COPD), childhood pustular dermatosis, Crohn's disease, deficiency of the interleukin-1 receptor antagonist (DIRA), deficiency of interleukin-36 receptor antagonist (DITRA), eczema, generalized pustular psoriasis (GPP), erythema elevatum diutinum, hidradenitis suppurativa, IgA pemphigus, inflammatory bowel disease (IBD), neutrophilic panniculitis, palmoplantar pustular psoriasis (PPP), psoriasis, psoriatic arthritis, pustular psoriasis (DIRA, DITRA), pyoderma gangrenosum, pyogenic arthritis pyoderma gangrenosum and acne (PAPA), pyogenic arthritis pyoderma gangrenosum acne and suppurative hidradenitis (PAPASH), rheumatoid neutrophilic dermatosis, synovitis acne pustulosis hyperostosis and osteitis (SAPHO), TNF-induced psoriasis form skin lesions in Crohn's patients, Sjogren's syndrome, Sweet's syndrome, systemic lupus erythematosus (SLE), ulcerative colitis, and uveitis.

"IL-36 stimulated signal," as used herein, refers to an intracellular signal initiated by binding any of the IL-36 cytokines, IL-36α, IL-36β, or IL-36γ, to its cognate receptor, IL-36R. Exemplary IL-36 stimulated signals include the release of IL-8 from HaCat cells and/or primary human adult or neonatal keratinocyte (HEKn or HEKa) cells, as well as signals measured using surrogate cell-based blocking assays, such as a HEK-BLUE™ IL-36 responsive cell-based assay as disclosed in the Examples herein.

"Cell-based blocking assay" refers to an assay in which the ability of an antibody to inhibit or reduce the biological activity of the antigen it binds can be measured. For example, a cell-based blocking assay can be used to measure the concentration of antibody required to inhibit a specific biological or biochemical function, such as IL-36 cytokine mediated intracellular signaling. In some embodiments, the half maximal inhibitory concentration ($IC_{50}$) and/or 90% inhibitory concentration ($IC_{90}$) of an antibody (e.g., an anti-IL-36 antibody of the disclosure) is measured using a cell-based blocking assay. In some embodiments, the cell-based blocking assay is used to determine whether an antibody blocks the interaction between an agonist (e.g., IL-36α, IL-36β, IL-36γ) and its cognate receptor. Cell-based blocking assays useful with the antibodies of the present disclosure can include cell-line based assays (e.g., HaCat cells) or primary cell assays (e.g., primary human keratinocytes) as well as reporter or sensor cell assays (e.g., a HEK-BLUE™ reporter cell assay). Exemplary cell-based blocking assays for the IL-36 signaling pathways are described in the Examples provided herein.

"Antibody," as used herein, refers to a molecule comprising one or more polypeptide chains that specifically binds to, or is immunologically reactive with, a particular antigen. Exemplary antibodies of the present disclosure include monoclonal antibodies, polyclonal antibodies, chimeric antibodies, humanized antibodies, human antibodies, multispecific (or heteroconjugate) antibodies (e.g., trispecific antibodies, bispecific antibodies, etc.), monovalent antibodies (e.g., single-arm antibodies), multivalent antibodies, antigen-binding fragments (e.g., Fab', F(ab')$_2$, Fab, Fv, rIgG, and scFv fragments), antibody fusions, and synthetic antibodies (or antibody mimetics).

"Anti-IL-36 antibody" or "antibody that binds IL-36" refers to an antibody that binds IL-36, including one or more of IL-36α, IL-36β, and IL-36γ, with sufficient affinity such that the antibody is useful as a diagnostic and/or therapeutic agent in targeting IL-36, i.e., one or more of IL-36α, IL-36β, and IL-36γ. In some embodiments, the extent of binding of an anti-IL-36 antibody to an unrelated, non-IL-36 antigen is less than about 10% of the binding of the antibody to IL-36 as measured, e.g., by a radioimmunoassay (RIA), by Surface plasmon resonance (SPR), or the like. In some embodiments, an antibody that binds to IL-36 has a dissociation constant ($K_D$) of <1 µM, <100 nM, <10 nM, <1 nM, <0.1 nM, <0.01 nM, or <1 µM (e.g., $10^{-8}$ M or less, e.g., from $10^{-8}$ M to $10^{-13}$ M, e.g., from $10^{-9}$ M to $10^{-13}$ M).

"Full-length antibody," "intact antibody," or "whole antibody" are used herein interchangeably to refer to an antibody having a structure substantially similar to a native antibody structure or having heavy chains that contain an Fc region as defined herein.

"Antibody fragment" refers to a portion of a full-length antibody which is capable of binding the same antigen as the full-length antibody. Examples of antibody fragments include, but are not limited to, Fv, Fab, Fab', Fab'-SH, F(ab')$_2$; diabodies; linear antibodies; monovalent, or single-armed antibodies; single-chain antibody molecules (e.g., scFv); and multispecific antibodies formed from antibody fragments.

"Class" of an antibody refers to the type of constant domain or constant region possessed by its heavy chain. There are five major classes of antibodies: IgA, IgD, IgE, IgG, and IgM, and several of these are further divided into subclasses (isotypes), e.g., IgG1, IgG2, IgG3, IgG4, IgA1, and IgA2. The heavy chain constant domains that correspond to the different classes of immunoglobulins are called α, δ, ε, γ, and µ, respectively.

"Variable region" or "variable domain" refers to the domain of an antibody heavy or light chain that is involved in binding the antibody to antigen. The variable domains of the heavy chain and light chain ($V_H$ and $V_L$, respectively) of a native antibody generally have similar structures, with each domain comprising four conserved framework regions (FRs) and three hypervariable regions (HVRs) (see, e.g., Kindt et al., Kuby Immunology, 6$^{th}$ ed., W. H. Freeman and Co., page 91). A single $V_H$ or $V_L$ domain may be sufficient to confer antigen-binding specificity. Furthermore, antibodies that bind a particular antigen may be isolated using a $V_H$ or $V_L$ domain from an antibody that binds the antigen to screen a library of complementary $V_L$ or $V_H$ domains, respectively (see, e.g., Portolano et al., J. Immunol. 150: 880-887 (1993); Clarkson et al., Nature 352:624-628 (1991)).

"Hypervariable region" or "HVR," as used herein, refers to each of the regions of an antibody variable domain which are hypervariable in sequence and/or form structurally defined loops ("hypervariable loops"). Generally, native antibodies comprise four chains with six HVRs; three in the heavy chain variable domain, $V_H$ (HVR-H1, HVR-H2, HVR-H3), and three in the light chain variable domain, $V_L$ (HVR-L1, HVR-L2, HVR-L3). The HVRs generally comprise amino acid residues from the hypervariable loops and/or from the "complementarity determining regions" (CDRs). A number of hypervariable region delineations are in use and are encompassed herein. The Kabat Complementarity Determining Regions (CDRs) are based on sequence variability and are the most commonly used (Kabat et al., Sequences of Proteins of Immunological Interest, 5th Ed. Public Health Service, National Institutes of Health, Bethesda, Md. (1991)). Chothia refers instead to the location of the structural loops (Chothia and Lesk J. Mol. Biol. 196 901-917 (1987)). The AbM hypervariable regions represent a compromise between the Kabat CDRs and Chothia structural loops and are used by Oxford Molecular's AbM antibody modeling software. The "contact" hypervariable regions are based on an analysis of the available complex crystal structures. The residues from each of these hypervariable regions are noted in the table below.

| Loop | Kabat | AbM | Chothia | Contact |
|------|-------|-----|---------|---------|
| L1 | L24-L34 | L24-L34 | L26-L32 | L30-L36 |
| L2 | L50-L56 | L50-L56 | L50-L52 | L46-L55 |
| L3 | L89-L97 | L89-L97 | L91-L96 | L89-L96 |
| H1 | H31-H35B[1] | H26-H35B[1] | H26-H32[1] | H30-H35B[1] |
|    | H31-H35[2]  | H26-H35[2]  | H26-H32[2] | H30-H35[2] |
| H2 | H50-H65 | H50-H58 | H53-H55 | H47-H58 |
| H3 | H95-H102 | H95-H102 | H96-H101 | H93-H101 |

[1]Kabat numbering
[2]Chothia numbering

Unless otherwise indicated, HVR residues and other residues in the variable domain (e.g., FR residues) are numbered herein according to Kabat et al., supra.

Hypervariable regions, as used herein, may include extended or alternative hypervariable regions as follows: 24-36 or 24-34 (L1), 46-56 or 50-56 (L2), and 89-97 or 89-96 (L3) in the $V_L$ domain and 26-35, 30-35, 30-35A, 30-35B, or 31-35B (H1), 50-61, 50-65 or 49-65 (H2) and 93-102, 94-102, or 95-102 (H3) in the $V_H$ domain. The variable domain residues are numbered according to Kabat et al., supra, for each of these definitions.

"Complementarity determining region," or "CDR," as used herein, refers to the regions within the HVRs of the variable domain which have the highest sequence variability and/or are involved in antigen recognition. Generally, native antibodies comprise four chains with six CDRs; three in the heavy chain variable domains, $V_H$ (H1, H2, H3), and three in the light chain variable domains, $V_L$ (L1, L2, L3). CDRs (CDR-L1, CDR-L2, CDR-L3, CDR-H1, CDR-H2, and CDR-H3) of exemplary anti-IL-36 antibodies of the present disclosure occur at amino acid residues 24-34 of L1, 50-56 of L2, 89-97 of L3, 30-35A of H1, 50-61 of H2, and 93-102 of H3. (Numbering according to Kabat et al., supra).

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in $V_H$ (or $V_L$): FR1-H1(L1)-FR2-H2(L2)-FR3-H3(L3)-FR4.

"Native antibody" refers to a naturally occurring immunoglobulin molecule. For example, native IgG antibodies are heterotetrameric glycoproteins of about 150,000 Daltons, composed of two identical light chains and two identical heavy chains that are disulfide-bonded. From N- to C-terminus, each heavy chain has a variable region ($V_H$), also called a variable heavy domain or a heavy chain variable domain, followed by three constant domains (CH1, CH2, and CH3). Similarly, from N- to C-terminus, each light chain has a variable region ($V_L$), also called a variable light domain or a light chain variable domain, followed by a constant light (CL) domain. The light chain of an antibody may be assigned to one of two types, called kappa (κ) and lambda (λ), based on the amino acid sequence of its constant domain.

"Monoclonal antibody" as used herein refers to an antibody obtained from a substantially homogeneous population of antibodies, i.e., the individual antibodies comprising the population are identical and/or bind the same epitope, except for possible variant antibodies (e.g., variant antibodies contain mutations that occur naturally or arise during production of a monoclonal antibody, and generally are present in minor amounts). In contrast to polyclonal antibody preparations, which typically include different antibodies directed against different determinants (epitopes), each monoclonal antibody of a monoclonal antibody preparation is directed against a single determinant on an antigen. Thus, the term "monoclonal" indicates the character of the antibody as being obtained from a substantially homogeneous population of antibodies and is not to be construed as requiring production of the antibody by any particular method. For example, the monoclonal antibodies to be used may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

"Chimeric antibody" refers to an antibody in which a portion of the heavy and/or light chain is derived from a particular source or species, while the remainder of the heavy and/or light chain is derived from a different source or species.

"Humanized antibody" refers to a chimeric antibody comprising amino acid sequences from non-human HVRs and amino acid sequences from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization.

"Human antibody" refers to an antibody which possesses an amino acid sequence corresponding to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

"Human consensus framework" is a framework which represents the most commonly occurring amino acid residues in a selection of human immunoglobulin $V_L$ or $V_H$ framework sequences. Generally, the selection of human immunoglobulin $V_L$ or $V_H$ sequences is from a subgroup of variable domain sequences. Generally, the subgroup of sequences is a subgroup as in Kabat et al., Sequences of Proteins of Immunological Interest, Fifth Edition, NIH Publication 91-3242, Bethesda MD (1991), vols. 1-3. In one embodiment, for the $V_L$, the subgroup is subgroup kappa I as in Kabat et al., supra. In one embodiment, for the $V_H$, the subgroup is subgroup III as in Kabat et al., supra.

"Acceptor human framework" as used herein is a framework comprising the amino acid sequence of a light chain variable domain ($V_L$) framework or a heavy chain variable domain ($V_H$) framework derived from a human immunoglobulin framework or a human consensus framework. An acceptor human framework "derived from" a human immunoglobulin framework or a human consensus framework may comprise the same amino acid sequence thereof, or it may contain amino acid sequence changes. In some embodiments, the number of amino acid changes are 10 or less, 9 or less, 8 or less, 7 or less, 6 or less, 5 or less, 4 or less, 3 or less, or 2 or less. In some embodiments, the $V_L$ acceptor human framework is identical in sequence to the $V_L$ human immunoglobulin framework sequence or human consensus framework sequence.

"Fc region," refers to a dimer complex comprising the C-terminal polypeptide sequences of an immunoglobulin heavy chain, wherein a C-terminal polypeptide sequence is that which is obtainable by papain digestion of an intact antibody. The Fc region may comprise native or variant Fc sequences. Although the boundaries of the Fc sequence of an immunoglobulin heavy chain may vary, the human IgG heavy chain Fc sequence is usually defined to stretch from an amino acid residue at about position Cys226, or from about position Pro230, to the carboxyl-terminus of the Fc sequence. However, the C-terminal lysine (Lys447) of the Fc sequence may or may not be present. The Fc sequence of an immunoglobulin generally comprises two constant domains, a CH2 domain and a CH3 domain, and optionally comprises a CH4 domain.

"Fc receptor" or "FcR," refers to a receptor that binds to the Fc region of an antibody. In some embodiments, an FcR is a native human FcR. In some embodiments, an FcR is one which binds an IgG antibody (a gamma receptor) and includes receptors of the FcγRI, FcγRII, and FcγRIII subclasses, including allelic variants and alternatively spliced forms of those receptors. FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain, (see, e.g., Daeron, Annu. Rev. Immunol.

15:203-234 (1997)). FcR, as used herein, also includes the neonatal receptor, FcRn, which is responsible for the transfer of maternal IgGs to the fetus (Guyer et al, J. Immunol. 1 17:587 (1976) and Kim et al, J. Immunol. 24249 (1994)) and regulation of homeostasis of immunoglobulins. FcRs are reviewed, for example, in Ravetch and Kinet, Annu. Rev. Immunol 9:457-92 (1991); Capel et al, Immunomethods 4:25-34 (1994); and de Haas et al, J. Lab. Clin. Med. 126:330-41 (1995).

"Multivalent antibody," as used herein, is an antibody comprising three or more antigen binding sites. The multivalent antibody is preferably engineered to have the three or more antigen binding sites and is generally not a native sequence IgM or IgA antibody.

"Multispecific antibody" is an antibody having at least two different binding sites, each site with a different binding specificity. A multispecific antibody can be a full-length antibody or an antibody fragment, and the different binding sites may bind each to a different antigen or the different binding sites may bind to two different epitopes of the same antigen.

"Fv fragment" refers to an antibody fragment which contains a complete antigen recognition and binding site. This region consists of a dimer of one heavy and one light chain variable domain in tight association, which can be covalent in nature, for example in scFv. It is in this configuration that the three HVRs of each variable domain interact to define an antigen binding site on the surface of the $V_H$-$V_L$ dimer. Collectively, the six HVRs or a subset thereof confer antigen binding specificity to the antibody. However, even a single variable domain (or half of an Fv comprising only three HVRs specific for an antigen) has the ability to recognize and bind antigen, although usually at a lower affinity than the entire binding site.

"Fab fragment' refers to an antibody fragment that contains a variable and constant domain of the light chain and a variable domain and the first constant domain (CH1) of the heavy chain. "F(ab')$_2$ fragments" comprise a pair of Fab fragments which are generally covalently linked near their carboxy termini by hinge cysteines between them. Other chemical couplings of antibody fragments also are known in the art.

"Antigen binding arm," as used herein, refers to a component of an antibody that has an ability to specifically bind a target molecule of interest. Typically, the antigen binding arm is a complex of immunoglobulin polypeptide sequences, e.g., HVR and/or variable domain sequences of an immunoglobulin light and heavy chain.

"Single-chain Fv" or "scFv" refer to antibody fragments comprising the $V_H$ and $V_L$ domains of an antibody, wherein these domains are present in a single polypeptide chain. Generally, an Fv polypeptide further comprises a polypeptide linker between the $V_H$ and $V_L$ domains which enables the scFv to form the desired antigen binding structure.

"Diabodies" refers to small antibody fragments with two antigen-binding sites, which fragments comprise a heavy chain variable domain ($V_H$) connected to a light chain variable domain ($V_L$) in the same polypeptide chain ($V_H$ and $V_L$). By using a linker that is too short to allow pairing between the two domains on the same chain, the domains are forced to pair with the complementary domains of another chain and create two antigen-binding sites.

"Linear antibodies" refers to the antibodies described in Zapata et al., Protein Eng., 8(10): 1057-1062 (1995). Briefly, these antibodies comprise a pair of tandem Fd regions (VH-CH1-VH-CH1) which, together with complementary light chain polypeptides, form a pair of antigen binding regions. Linear antibodies can be multispecific, such as e.g., trispecific or bispecific, or monospecific.

"Naked antibody" refers to an antibody that is not conjugated to a heterologous moiety (e.g., a cytotoxic moiety) or radiolabel.

"Affinity" refers to the strength of the total of noncovalent interactions between a single binding site of a molecule (e.g., an antibody) and its binding partner (e.g., an antigen). "Binding affinity" refers to intrinsic binding affinity which reflects a 1:1 interaction between members of a binding pair (e.g., antibody and antigen). The affinity of a molecule X for its partner Y can generally be represented by the equilibrium dissociation constant ($K_D$). Affinity can be measured by common methods known in the art, including those described herein. Specific illustrative and exemplary embodiments for measuring binding affinity are described in the following.

"Binds specifically" or "specific binding" refers to binding of an antibody to an antigen with an affinity value of no more than about $1 \times 10^{-7}$ M.

"Affinity matured" antibody refers to an antibody with one or more alterations in one or more HVRs, compared to a parent antibody which does not possess such alterations, such alterations resulting in an improvement in the affinity of the antibody for antigen.

"Functional antigen binding site" of an antibody is one which is capable of binding a target antigen. The antigen binding affinity of the antigen binding site is not necessarily as strong as the parent antibody from which the antigen binding site is derived, but the ability to bind antigen must be measurable using any one of a variety of methods known for evaluating antibody binding to an antigen.

"Isolated antibody" refers to an antibody which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic methods (e.g., ion exchange or reverse phase HPLC). For review of methods for assessment of antibody purity, see, e.g., Flatman et al., J. Chromatogr. B 848:79-87.

"Substantially similar" or "substantially the same," as used herein, refers to a sufficiently high degree of similarity between two numeric values (for example, one associated with a test antibody and the other associated with a reference antibody), such that one of skill in the art would consider the difference between the two values to be of little or no biological and/or statistical significance within the context of the biological characteristic measured by said values (e.g., $K_D$ values).

"Substantially different," as used herein, refers to a sufficiently high degree of difference between two numeric values (generally one associated with a molecule and the other associated with a reference molecule) such that one of skill in the art would consider the difference between the two values to be of statistical significance within the context of the biological characteristic measured by said values (e.g., $K_D$ values).

"Effector functions" refer to those biological activities attributable to the Fc region of an antibody, which vary with the antibody isotype. Examples of antibody effector functions include: Clq binding and complement dependent cytotoxicity (CDC); Fc receptor binding; antibody-dependent cell-mediated cytotoxicity (ADCC); phagocytosis; down regulation of cell surface receptors (e.g., B cell receptor); and B cell activation.

"Immunoconjugate" refers to an antibody conjugated to one or more heterologous molecule(s), including but not limited to a cytotoxic agent.

"Treatment," "treat" or "treating" refers to clinical intervention in an attempt to alter the natural course of a disorder in the individual being treated and can be performed either for prophylaxis or during the course of clinical pathology. Desired results of treatment can include, but are not limited to, preventing occurrence or recurrence of the disorder, alleviation of symptoms, diminishment of any direct or indirect pathological consequences of the disorder, preventing metastasis, decreasing the rate of progression, amelioration or palliation of a disease state, and remission or improved prognosis. For example, treatment can include administration of a therapeutically effective amount of pharmaceutical formulation comprising an anti-IL-36 antibody to a subject to delay development or slow progression of a disease or condition mediated by IL-36 or disease or condition in which IL-36, or a downstream pathways stimulated by an IL-36 cytokine, may play a role in the pathogenesis and/or progression.

"Pharmaceutical formulation" refers to a preparation in a form that allows the biological activity of the active ingredient(s) to be effective, and which contain no additional components which are toxic to the subjects to which the formulation is administered. A pharmaceutical formulation may include one or more active agents. For example, a pharmaceutical formulation may include an anti-IL-36 antibody as the sole active agent of the formulation or may include an anti-IL-36 antibody and one or more additional active agents.

By "sole active agent", as used herein, is meant that the agent referred to is the only agent present in the formulation, or used in the therapy, that provides, or would be expected to provide, the relevant pharmacological effect to treat the subject for the condition, consistent with the description of "treatment" as provided herein. A pharmaceutical formulation comprising a sole active agent does not exclude the presence of one or more non-active agents, such as e.g., a pharmaceutically acceptable carrier, in the formulation. A "non-active agent" is an agent that would not be expected to provide, or otherwise significantly contribute to, the relevant pharmacological effect intended to treat the subject for the condition.

"Pharmaceutically acceptable carrier" refers to an ingredient in a pharmaceutical formulation, other than an active ingredient, which is nontoxic to the subject to whom it is administered. A pharmaceutically acceptable carrier includes, but is not limited to, a buffer, excipient, stabilizer, or preservative.

"Therapeutically effective amount" refers to the amount of an active ingredient or agent (e.g., a pharmaceutical formulation) to achieve a desired therapeutic or prophylactic result, e.g., to treat or prevent a disease, disorder, or condition in a subject. In the case of an IL-36 mediated disease or condition, the therapeutically effective amount of the therapeutic agent is an amount that reduces, prevents, inhibits, and/or relieves to some extent one or more of the symptoms associated with the disease, disorder, or condition. For treatment of inflammatory conditions, such as skin inflammatory conditions (e.g., eczema, psoriasis, rosacea, seborrheic dermatitis), efficacy in vivo can, for example, be measured by assessing the duration, severity, and/or recurrence of symptoms, the response rate (RR), duration of response, and/or quality of life.

"Concurrently," as used herein, refers to administration of two or more therapeutic agents, where at least part of the administration overlaps in time. Accordingly, concurrent administration includes a dosing regimen when the administration of one or more agent(s) continues after discontinuing the administration of one or more other agent(s).

"Individual" or "subject" refers to a mammal, including but not limited to, domesticated animals (e.g., cows, sheep, cats, dogs, and horses), primates (e.g., humans and non-human primates such as monkeys), rabbits, and rodents (e.g., mice and rats).

Detailed Description of Various Embodiments

I. IL-36 Cytokines

Each of the agonist cytokines IL-36α, IL-36β, and IL-36γ induces intracellular signaling by binding to the cognate receptor, IL-36R (or IL1 RL2). Binding by any of these IL-36 cytokines to the IL-36R receptor causes recruitment and engagement of co-receptor IL1 RAP, resulting in the formation of a ternary signaling complex comprising IL-36R, IL1RAP, and the respective IL-36 cytokine that initiated the signaling event. Signal transduction stimulated by IL-36α, IL-36β, or IL-36γ leads to activation of the NK-κB transcription factor and AP-1 pathways in target cells and induces various inflammatory, proliferative, and pathogenic immune responses. See, e.g., Jennifer Towne et al., *J. Biol. Chem.* 279(14):13677-13688 (2004); Sebastian Gunther et al., *J. Immunol.* 193(2):921-930 (2014).

The IL-36 cytokines, IL-36α, IL-36β, and IL-36γ, are relatively short proteins that bind to and act as agonists of the receptor IL-36R. In vivo, the IL-36 cytokines undergo proteolytic processing that results in N-terminal truncation. This truncation is necessary for IL-36α, IL-36β, and IL-36γ to achieve their full agonist activity with IL-36R. Similarly, the IL-36R antagonist, IL-36Ra requires N-terminal truncation in order to achieve it full antagonist activity. The amino acid and nucleotide sequences and annotation of human versions of IL-36α, IL-36β, IL-36γ (also referred to herein as "hu-IL-36α," "hu-IL-36β," and "hu-IL-36γ") and IL-36Ra are publicly available. See e.g, full amino acid sequences at UniProt entry numbers Q9UHA7, Q9NZH7-2, Q9NZH8, and Q9UBH0, respectively. Similarly, amino acid and nucleotide sequences of the versions of the three IL-36 cytokines from cynomolgus monkey, referred to herein as "cy-IL-36α," "cy-IL-36β," and "cy-IL-36γ," also are publicly available at UniProt entry numbers A0A2K5UTG0, A0A2K5UV63-1, and A0A2K5VYV6.

Polypeptide constructs corresponding to portions of the hu-IL-36 and cy-IL-36 cytokine proteins can be used as antigens to elicit anti-IL-36 antibodies with binding affinity for the human and/or cynomolgus monkey versions of the specific IL-36 cytokines, IL-36α, IL-36β, and IL-36γ. As disclosed elsewhere herein, these anti-IL-36 antibodies are capable of partially or fully-blocking the binding of one or more of the specific cytokines IL-36α, IL-36β, and IL-36γ to its cognate receptor, and thereby decreasing intracellular signals initiated by this binding. Antibodies produced by immunization with IL-36 antigens may be modified, e.g., as described herein, to modulate (enhance or reduce) certain properties of the antibodies, including but not limited to e.g., enhancing affinity for the IL-36 antigen, enhancing affinity for another IL-36 antigen, enhancing cross-reactivity, reducing cross-reactivity, etc.

Table 1 below provides a summary description of the sequences of the human and cynomolgus monkey IL-36 polypeptide constructs used to generate anti-IL-36 antibodies of the present disclosure and their sequence identifiers. The UniProt database entry identifiers of the proteins are also included as well as the domain boundaries of the construct sequence relative to the full-length proteins. The sequences of each of the IL-36α, IL-36β, IL-36γ, or IL-36Ra polypeptide constructs correspond to the N-terminal truncated version having the highest agonist activity, or in the case of IL-36Ra, antagonist activity. For example, the N-terminal truncated IL-36α, IL-36β, and IL-36γ amino acid sequences provided in Table 1 begin at N-terminal positions K6, R5, and S18, respectively. Additionally, the purification tag sequences used to make easily purifiable versions of the IL-36 proteins as described elsewhere herein. The sequences also are included in the accompanying Sequence Listing.

II. Anti-IL-36 Antibodies

In some embodiments, the present disclosure provides structures of anti-IL-36 antibodies in terms of the amino acid and encoding nucleotide sequences of the various well-known immunoglobulin features (e.g., CDRs, HVRs, FRs, $V_H$, and $V_L$ domains). Table 2 below provides a summary description of exemplary anti-IL-36 antibody sequences of the present disclosure, and their sequence identifiers. These sequences and others are included in the accompanying Sequence Listing.

TABLE 1

IL-36 sequences and purification tags

| Description | Domain boundary | Sequence | SEQ ID NO: |
|---|---|---|---|
| hu-IL-36α (UniProt Q9UHA7) | K6-F158 | KIDTPQQGSIQDINHRVWVLQDQTLIAVPRKDRMSPVTIALISCR HVETLEKDRGNPIYLGLNGLNLCLMCAKVGDQPTLQLKEKDIMDL YNQPEPVKSFLFYHSQSGRNSTFESVAFPGWFIAVSSEGGCPLIL TQELGKANTTDFGLTMLF | 1 |
| hu-IL-36β (UniProt Q9NZH7-2) | R5-E157 | REAAPKEYAIRDSRQMVWVLSGNSLIAAPLSRSIKPVTLHLIACR DTEFSDKEKGNMVYLGIKGKDLCLFCAEIQGKPTLQLKEKNIMDL YVEKKAQKPFLFFHNKEGSTSVFQSVSYPGWFIATSTTSGQPIFL TKERGITNNTNFYLDSVE | 2 |
| hu-IL-36γ (UniProt Q9NZH8) | S18-D169 | SMCKPITGTINDLNQQVWTLQGQNLVAVPRSDSVTPVTVAVITCK YPEALEQGRGDPIYLGIQNPEMCLYCEKVGEQPTLQLKEQKIMDL YGQPEPVKPFLFYRAKTGRTSTLESVAFPDWFIASSKRDQPIILT SELGKSYNTAFELNIND | 3 |
| hu-IL-36Ra (UniProt Q9UBH0) | V2-D155 | VLSGALCFRMKDSALKVLYLHNNQLLAGGLHAGKVIKGEEISVVP NRWLDASLSPVILGVQGGSQCLSCGVGQEPTLTLEPVNIMELYLG AKESKSFTFYRRDMGLTSSFESAAYPGWFLCTVPEADQPVRLTQL PENGGWNAPITDFYFQQCD | 4 |
| cy-IL-36α (UniProt A0A2K5UTG0) | K6-F158 | KSEMPQPVSIQDINHRVWVLQDQILIAVPRKDRVSPVTISLISCR HVETLEKDRGNPIYLGLNGLNLCLMCAKAGDQPTLQLKEKDIMDL YNQPEPVKSFLFYHSQSGRNSTFESVAFPGWFIAVSSEGGCPLIL TQELGKANTTDFGLTMLF | 5 |
| cy-IL-36β (UniProt A0A2K5UV63-1) | W5-E157 | WQAAPKEYAIRDSRQMVWVLSGNSLIAAPLSNRVKPVTLHLITCR DTEFSDKKKGNLVYLGIRGKDLCLFCEEIQGKPTLQLKEKNIMDL YMEKKAQKPFLFFHNKEGSSSVFQSVSYPGWFIATSSTSGQPIFL TQERGITNNTNFYLDSVE | 6 |
| cy-IL-36γ (UniProt A0A2K5VYV6) | S18-K168 | SMRTPITGTINDLNQQVWTLQGQILVAVPRSDSVTPVTVAVITCK YPEALDQSRGDPIYLGIRNPEMCLCCEEVGGQPTLQLKEQKIMDL YGQPEPVKPFLFYRVKTGRTSTLESVAFPNWFIASSTRDQPIILT SELGKSYNTAFELNIK | 7 |
| 12xHis-SUMO | n/a | MHHHHHHHHHHHHMSDSEVNQEAKPEVKPEVKPETHINLKVSDGS SEIFFKIKKTTPLRRLMEAFAKRQGKEMDSLRFLYDGIRIQADQT PEDLDMEDNDIIEAHREQIGG | 8 |
| 12xHis-TEV | n/a | MHHHHHHHHHHHHENLYFQS | 9 |
| GS-AviTag | n/a | GGGGSGLNDIFEAQKIEWHE | 10 |
| signal sequence (mouse Ig heavy chain V region 102) | n/a | MGWSCIILFLVATATGVHS | 11 |
| GS-TEV-GS-huIgG1Fc-FLAG | n/a | SGGGGSENLYFQGGGGSEPKSCDKTHTCPPCPAPELLGGPSVFLF PPKPKDTLMISRTPEVTCVVVDVSHEDPEVKFNWYVDGVEVHNAK TKPREEQYNSTYRVVSVLTVLHQDWLNGKEYKCKVSNKALPAPIE KTISKAKGQPREPQVYTLPPSRDELTKNQVSLTCLVKGFYPSDIA VEWESNGQPENNYKTTPPVLDSDGSFFLYSKLTVDKSRWQQGNVF SCSVMHEALHNHYTQKSLSLSPGKDYKDDDDK | 12 |

TABLE 2

Anti-IL-36 antibody sequences

| Description | Sequence | SEQ ID NO: |
|---|---|---|
| mAb1.0-VL | QSVLTQPPSVSGAPGQRVTISCTGSSSNIGAHYDVHWYQQLPGTAPKLLIY SNNNRPSGVPDRFSGSKSGTSASLAITGLQAEDEADYYCQSYDYSLRGYVF GGGTKLTVL | 13 |
| MAb1.0-HVR-L1 | TGSSSNIGAHYDVH | 14 |
| mAb1.0-HVR-L2 | SNNNRPS | 15 |
| mAb1.0-HVR-L3 | QSYDYSLRGYV | 16 |
| mAb2.0-VL and mAb6.0_2.0-VL | QSVLTQPPSVSGAPGQRVTISCTGSSSNIGAHYDVHWYQQLPGTAPKLLIY GNDNRPSGVPDRFSGSKSGTSASLAITGLQAEDEADYYCQSYDYSLSGYVF GGGTKLTVL | 17 |
| MAb2, MAb6_2, mAb6_2.7, and mAb2.10-VL | ESVLTQPPSVSGAPGQRVTISCTGSSSNIGAHYDVHWYQQLPGTAPKLLIY GNDNRPSGVPDRFSGSKSGTSASLAITGLQAEDEADYYCQSYDYSLSGYVF GGGTKLTVL | 77 |
| MAb2.0, MAb2, mAb6_2, mAb6_2.7, and mAb2.10-HVR-L1 | TGSSSNIGAHYDVH | 18 |
| mAb2.0, mAb2, mAb6_2, mAb6_2.7, and mAb2.10-HVR-L2 | GNDNRPS | 19 |
| mAb2.0, mAb2, mAb6_2, mAb6_2.7, and mAb2.10-HVR-L3 | QSYDYSLSGYV | 20 |
| mAb3.0-VL | QSVLTQPPSVSGAPGQRVTISCTGSSSNIGAGYDVHWYQQLPGTAPKLLIY GNTNRPSGVPDRFSGSKSGTSASLAITGLQAEDEADYYCQSYDYSLRGYVF GGGTKLTVL | 21 |
| mAb3.0-HVR-L1 | TGSSSNIGAGYDVH | 22 |
| mAb3.0-HVR-L2 | GNTNRPS | 23 |
| mAb3.0-HVR-L3 | QSYDYSLRGYV | 24 |
| mAb4.0-VL | QSVLTQPPSVSGAPGQRVTISCTGSSSNIGAGYDVHWYQQLPGTAPKLLIY GNRNRPSGVPDRFSGSKSGTSASLAITGLQAEDEADYYCQSYDYSLRVYVF GGGTKLTVL | 25 |
| mAb4.0-HVR-L1 | TGSSSNIGAGYDVH | 26 |
| mAb4.0-HVR-L2 | GNRNRPS | 27 |
| mAb4.0-HVR-L3 | QSYDYSLRVYV | 28 |
| mAb5.0-VL | QSVLTQPPSVSGAPGQRVTISCTGSSSNIGAHYDVHWYQQLPGTAPKLLIY GNDNRPSGVPDRFSGSKSGTSASLAITGLQAEDEADYYCQSYDYSLKAYVF GGGTKLTVL | 29 |
| mAb5.0-HVR-L1 | TGSSSNIGAGYDVH | 30 |
| mAb5.0-HVR-L2 | GNDNRPS | 31 |
| mAb5.0-HVR-L3 | QSYDYSLKAYV | 32 |
| mAb6.0-VL | QSVLTQPPSVSGAPGQRVTISCTGSSSNIGAGYDVHWYQQLPGTAPKLLIY GNTNRPSGVPDRFSGSKSGTSASLAITGLQAEDEADYYCQSYDISLSGWVF GGGTKLTVL | 33 |
| mAb6-VL | ESVLTQPPSVSGAPGQRVTISCTGSSSNIGAGYDVHWYQQLPGTAPKLLIY GNTNRPSGVPDRFSGSKSGTSASLAITGLQAEDEADYYCQSYDISLSGWVF GGGTKLTVL | 78 |
| mAb6.0 and mAb6-HVR-L1 | TGSSSNIGAGYDVH | 34 |

TABLE 2-continued

Anti-IL-36 antibody sequences

| Description | Sequence | SEQ ID NO: |
|---|---|---|
| mAb6.0 and mAb6-HVR-L2 | GNTNRPS | 35 |
| mAb6.0 and mAb6-HVR-L3 | QSYDISLSGWV | 36 |
| mAb7.0-VL | EIVLTQSPGTLSLSPGERATLSCRASQSVSSNYLAWYQQKPGQAPKLLIYSASSLQSGVPSRFSGSGSGTDFTLTISSLQPEDFATYYCQQTYSYPPTFGQGTKVEIK | 37 |
| mAb7.0-HVR-L1 | RASQSVSSNYLA | 38 |
| mAb7.0-HVR-L2 | SASSLQS | 39 |
| mAb7.0-HVR-L3 | QQTYSYPPT | 40 |
| mAb8.0-VL | DIQMTQSPSSLSASVGDRVTITCRASQTIYKYLNWYQQKPGKAPKLLIYAASSLQSGVPSRFSGSGSGTDFTLTISSLQPEDFATYYCQQYSSIPYTFGQGTKVEIK | 41 |
| mAb8.0-HVR-L1 | RASQTIYKYLN | 42 |
| mAb8.0-HVR-L2 | AASSLQS | 43 |
| mAb8.0-HVR-L3 | QQYSSIPYT | 44 |
| mAb1.0-VH | QVQLVESGGGVVQPGRSLRLSCAASGFSFSAYAMHWVRQAPGKGLEWVAVISYDGTNEYYADSVKGRFTISRDNSKNTLYLQMNSLRAEDTAVYYCARGIRIFTSYFDSWGQGTLVTVSS | 45 |
| mAb1.0-HVR-H1 | SAYAMHW | 46 |
| mAb1.0-HVR-H2 | VISYDGTNEYYAD | 47 |
| mAb1.0-HVR-H3 | ARGIRIFTSYFDS | 48 |
| mAb2.0-VH | QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSS | 49 |
| mAb2-VH | ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSS | 79 |
| mAb2.0 and mAb2-HVR-H1 | STSSYYW | 50 |
| mAb2.0 and mAb2-HVR-H2 | SIYYTGNTYYNP | 51 |
| mAb2.0 and mAb2-HVR-H3 | ARVRYGVGVPRYFDP | 52 |
| mAb3.0-VH | QLQLQESGPGLVKPSETLSLTCTVSGGSISSTSYYWGWIRQPPGKGLEWIGSIHYSGNTYYNPSLKSRVTISVDTSKNQFSLKLSSVTAADTAVYYCARVHYGGYIPRRFDHWGQGTLVTVSS | 53 |
| mAb3.0-HVR-H1 | SSTSYYW | 54 |
| mAb3.0-HVR-H2 | SIHYSGNTYYNP | 55 |
| mAb3.0-HVR-H3 | ARVHYGGYIPRRFDH | 56 |
| mAb4.0-VH | QLQLQESGPGLVKPSETLSLTCTVSGGSIGSRSYYWGWIRQPPGKGLEWIGSIHYSGTTYYNPSLKSRVTISVDTSKNQFSLKLSSVTAADTAVYYCARVAPSYPRVFDYWGQGTLVTVSS | 57 |
| mAb4.0-HVR-H1 | GSRSYYW | 58 |
| mAb4.0-HVR-H2 | SIHYSGTTYYNP | 59 |
| mAb4.0-HVR-H3 | ARVAPSYPRVFDY | 60 |

TABLE 2-continued

Anti-IL-36 antibody sequences

| Description | Sequence | SEQ ID NO: |
|---|---|---|
| mAb5.0-VH | EVQLLESGGGLVQPGGSLRLSCAASGFTFSTYAMSWVRQAPGKGLEWVSGI SGGSGYTYYADSVKGRFTISRDNSKNTLYLQMNSLRAEDTAVYYCARVVTY RDPPASFDYWGQGTLVTVSS | 61 |
| mAb5.0-HVR-H1 | STYAMS | 62 |
| mAb5.0-HVR-H2 | GISGGSGYTYYAD | 63 |
| mAb5.0-HVR-H3 | ARVVTYRDPPASFDY | 64 |
| mAb6.0 and mAb6.0_2.0-VH | QLQLQESGPGLVKPSETLSLTCTVSGGSITSSNYYWGWIRQPPGKGLEWIG SIDYTGSTYYNPSLKSRVTISVDTSKNQFSLKLSSVTAADTAVYYCARGKY YETYLGFDVWGQGTLVTVSS | 65 |
| mAb6 and mAb6_2-VH | ELQLQESGPGLVKPSETLSLTCTVSGGSITSSNYYWGWIRQPPGKGLEWIG SIDYTGSTYYNPSLKSRVTISVDTSKNQFSLKLSSVTAADTAVYYCARGKY YETYLGFDVWGQGTLVTVSS | 80 |
| mAb6.0 and mAb6 and mAb6.0_2.0 and mAb6_2-HVR-H1 | TSSNYYW | 66 |
| mAb6.0 and mAb6 and mAb6.0_2.0 and mAb6_2-HVR-H2 | SIDYTGSTYYNP | 67 |
| mAb6.0 and mAb6 and mAb6.0_2.0 and mAb6_2-HVR-H3 | ARGKYYETYLGFDV | 68 |
| mAb7.0-VH | QVQLVESGGGVVQPGRSLRLSCAASGFTFSSYGMHWVRQAPGKGLEWVAVI SYGGSERYYADSVKGRFTISRDNSKNTLYLQMNSLRAEDTAVYYCAREPWY SSRGWTGYGFDVWGQGTLVTVSS | 69 |
| mAb7.0-HVR-H1 | SSYGMH | 70 |
| mAb7.0-HVR-H2 | VISYGGSERYYAD | 71 |
| mAb7.0-HVR-H3 | AREPWYSSRGWTGYGFDV | 72 |
| mAb8.0-VH | QVQLVQSGAEVKKPGSSVKVSCKASGGTFSNYAISWVRQAPGQGLEWMGGI LPILGTVDYAQKFQGRVTITADESTSTAYMELSSLRSEDTAVYYCAREPWY RLGAFDVWGQGTLVTVSS | 73 |
| mAb8.0-HVR-H1 | SNYAIS | 74 |
| mAb8.0-HVR-H2 | GILPILGTVDYAQ | 75 |
| mAb8.0-HVR-H3 | AREPWYRLGAFDV | 76 |
| mAb6_2.1-VH | ELQLQESGPGLVKPSETLSLTCTVSGGSITSTNYYWGWIRQPPGKGLEWIG NIDYTGSTYYNASLKSRVTISVDTSKNQFSLKLSSVTAADTAVYYCATGKY YETYLGFDVWGQGTLVTVSS | 81 |
| mAb6_2.1-HVR-H1 | TSTNYYW | 82 |
| mAb6_2.1-HVR-H2 | NIDYTGSTYYNA | 83 |
| mAb6_2.1-HVR-H3 | ATGKYYETYLGFDV | 84 |
| mAb6_2.2-VH | ELQLQESGPGLVKPSETLSLTCTVSGGSITSSNAYWGWIRQPPGKGLEWIG SIDYTGSTAYNPSLKSRVTISVDTSKNQFSLKLSSVTAADTAVYYCAHGKY YETYLGFDVWGQGTLVTVSS | 85 |
| mAb6_2.2-HVR-H1 | TSSNAYW | 86 |
| mAb6_2.2-HVR-H2 | SIDYTGSTAYNP | 87 |
| mAb6_2.2-HVR-H3 | AHGKYYETYLGFDV | 88 |

TABLE 2-continued

Anti-IL-36 antibody sequences

| Description | Sequence | SEQ ID NO: |
|---|---|---|
| mAb6_2.3-VH | ELQLQESGPGLVKPSETLSLTCTVSGGSI<u>TASNYYW</u>GWIRQPPGKGLEWIG <u>SIDYTGSTYYNT</u>SLKSRVTISVDTSKNQF<u>S</u>LKLSSVTAADTAVYYC<u>ATGKY YETYLGFDV</u>WGQGTLVTVSS | 89 |
| mAb6_2.3-HVR-H1 | TASNYYW | 90 |
| mAb6_2.3-HVR-H2 | SIDYTGSTYYNT | 91 |
| mAb6_2.3-HVR-H3 | ATGKYYETYLGFDV | 92 |
| mAb6_2.4-VH | ELQLQESGPGLVKPSETLSLTCTVSGGSI<u>TASNYYW</u>GWIRQPPGKGLEWIG <u>SIDYTGSTYYNP</u>SLKSRVTISVDTSKNQF<u>S</u>LKLSSVTAADTAVYYC<u>ATGKY YETYLGFDV</u>WGQGTLVTVSS | 93 |
| mAb6_2.4-HVR-H1 | TASNYYW | 94 |
| mAb6_2.4-HVR-H2 | SIDYTGSTYYNP | 95 |
| mAb6_2.4-HVR-H3 | ATGKYYETYLGFDV | 96 |
| mAb6_2.5-VH | ELQLQESGPGLVKPSETLSLTCTVSGGSI<u>TASNYYW</u>GWIRQPPGKGLEWIG <u>SIDYTGSTYYEP</u>SLKSRVTISVDTSKNQF<u>S</u>LKLSSVTAADTAVYYC<u>ATGSY YETYLGFDV</u>WGQGTLVTVSS | 97 |
| mAb6_2.5-HVR-H1 | TASNYYW | 98 |
| mAb6_2.5-HVR-H2 | SIDYTGSTYYEP | 99 |
| mAb6_2.5-HVR-H3 | ATGSYYETYLGFDV | 100 |
| mAb6_2.6-VH | ELQLQESGPGLVKPSETLSLTCTVSGGSI<u>TASNYYW</u>GWIRQPPGKGLEWIG <u>SIDYTGSTYYEP</u>SLKSRVTISVDTSKNQF<u>S</u>LKLSSVTAADTAVYYC<u>ATGNY YETYLGFDV</u>WGQGTLVTVSS | 101 |
| mAb6_2.6-HVR-H1 | TASNYYW | 102 |
| mAb6_2.6-HVR-H2 | SIDYTGSTYYEP | 103 |
| mAb6_2.6-HVR-H3 | ATGNYYETYLGFDV | 104 |
| mAb6_2.7-VH | ELQLQESGPGLVKPSETLSLTCTVSGGSI<u>TASNTYW</u>GWIRQPPGKGLEWIG <u>SIDYTGSTYYNP</u>SLKSRVTISVDTSKNQF<u>S</u>LKLSSVTAADTAVYYC<u>ATGKY YETYLGFDV</u>WGQGTLVTVSS | 105 |
| mAb6_2.7-HVR-H1 | TASNTYW | 106 |
| mAb6_2.7-HVR-H2 | SIDYTGSTYYNP | 107 |
| mAb6_2.7-HVR-H3 | ATGKYYETYLGFDV | 108 |
| mAb6_2.8-VH | ELQLQESGPGLVKPSETLSLTCTVSGGSI<u>TASNYYW</u>GWIRQPPGKGLEWIG <u>SIDYTGSTYYNP</u>SLKSRVTISVDTSKNQF<u>S</u>LKLSSVTAADTAVYYC<u>ASGKY YETYLGFDV</u>WGQGTLVTVSS | 109 |
| mAb6_2.8-HVR-H1 | TASNYYW | 110 |
| mAb6_2.8-HVR-H2 | SIDYTGSTYYNP | 111 |
| mAb6_2.8-HVR-H3 | ASGKYYETYLGFDV | 112 |
| mAb6_2.9-VH | ELQLQESGPGLVKPSETLSLTCTVSGGSI<u>TSSNYYW</u>GWIRQPPGKGLEWIG <u>SIDYTGSTYYNP</u>SLKSRVTISVDTSKNQF<u>S</u>LKLSSVTAADTAVYYC<u>ATGKY YETYLGFDV</u>WGQGTLVTVSS | 113 |
| mAb6_2.9-HVR-H1 | TSSNYYW | 114 |
| mAb6_2.9-HVR-H2 | SIDYTGSTYYNP | 115 |
| mAb6_2.9-HVR-H3 | ATGKYYETYLGFDV | 116 |
| mAb6_2.10-VH | ELQLQESGPGLVKPSETLSLTCTVSGGSI<u>TSSNYYW</u>GWIRQPPGKGLEWIG <u>SIDYTGSTYYQP</u>SLKSRVTISVDTSKNQF<u>S</u>LKLSSVTAADTAVYYC<u>ARGNY YETYLGFDV</u>WGQGTLVTVSS | 117 |

TABLE 2-continued

Anti-IL-36 antibody sequences

| Description | Sequence | SEQ ID NO: |
|---|---|---|
| mAb6_2.10-HVR-H1 | TSSNYYW | 118 |
| mAb6_2.10-HVR-H2 | SIDYTGSTYYQP | 119 |
| mAb6_2.10-HVR-H3 | ARGNYYETYLGFDV | 120 |
| mAb2.1-VH | ELQLQESGPGLVKPSETLSLTCTVSGGSISDSSYYWGWIRQPPGKGLEWIG SIYYTGNTYYNSLKSRVTISVDTSKNQFSLKLSSVTAADTAVYYCARVRY GVGVPRYFDPWGQGTLVTVSS | 121 |
| mAb2.1-HVR-H1 | SDSSYYW | 122 |
| mAb2.1-HVR-H2 | SIYYTGNTYYNS | 123 |
| mAb2.1-HVR-H3 | ARVRYGVGVPRYFDP | 124 |
| mAb2.2-VH | ELQLQESGPGLVKPSETLSLTCTVSGGSISESSYYWGWIRQPPGKGLEWIG SIYYTGNTYYNPSLKSRVTISVDTSKNQFSLKLSSVTAADTAVYYCAGVRY GVGVPRYFDPWGQGTLVTVSS | 125 |
| mAb2.2-HVR-H1 | SESSYYW | 126 |
| mAb2.2-HVR-H2 | SIYYTGNTYYNP | 127 |
| mAb2.2-HVR-H3 | AGVRYGVGVPRYFDP | 128 |
| mAb2.3-VH | ELQLQESGPGLVKPSETLSLTCTVSGGSISTSSDYWGWIRQPPGKGLEWIG SIYYTGNTYYLPSLKSRVTISVDTSKNQFSLKLSSVTAADTAVYYCSRVRY GVGVPRYFDPWGQGTLVTVSS | 129 |
| mAb2.3-HVR-H1 | STSSDYW | 130 |
| mAb2.3-HVR-H2 | SIYYTGNTYYLP | 131 |
| mAb2.3-HVR-H3 | SRVRYGVGVPRYFDP | 132 |
| mAb2.4-VH | ELQLQESGPGLVKPSETLSLTCTVSGGSISNSSYYWGWIRQPPGKGLEWIG SIYYTGNTYYLPSLKSRVTISVDTSKNQFSLKLSSVTAADTAVYYCARVRY GVGVPRYFDPWGQGTLVTVSS | 133 |
| mAb2.4-HVR-H1 | SNSSYYW | 134 |
| mAb2.4-HVR-H2 | SIYYTGNTYYLP | 135 |
| mAb2.4-HVR-H3 | ARVRYGVGVPRYFDP | 136 |
| mAb2.5-VH | ELQLQESGPGLVKPSETLSLTCTVSGGSISESSYYWGWIRQPPGKGLEWIG SIYYTGNTYYLPSLKSRVTISVDTSKNQFSLKLSSVTAADTAVYYCARVRY GVGVPRYFDPWGQGTLVTVSS | 137 |
| mAb2.5-HVR-H1 | SESSYYW | 138 |
| mAb2.5-HVR-H2 | SIYYTGNTYYLP | 139 |
| mAb2.5-HVR-H3 | ARVRYGVGVPRYFDP | 140 |
| mAb2.6-VH | ELQLQESGPGLVKPSETLSLTCTVSGGSISTSSYHWGWIRQPPGKGLEWIG SIYYTGNTYYMPSLKSRVTISVDTSKNQFSLKLSSVTAADTAVYYCVRVRY GVGVPRYFDPWGQGTLVTVSS | 141 |
| mAb2.6-HVR-H1 | STSSYHW | 142 |
| mAb2.6-HVR-H2 | SIYYTGNTYYMP | 143 |
| mAb2.6-HVR-H3 | VRVRYGVGVPRYFDP | 144 |
| mAb2.7-VH | ELQLQESGPGLVKPSETLSLTCTVSGGSISRSSYYWGWIRQPPGKGLEWIG SIYYTGNTYYWPSLKSRVTISVDTSKNQFSLKLSSVTAADTAVYYCTRVRY GVGVPRYFDPWGQGTLVTVSS | 145 |
| mAb2.7-HVR-H1 | SRSSYYW | 146 |
| mAb2.7-HVR-H2 | SIYYTGNTYYWP | 147 |

TABLE 2-continued

Anti-IL-36 antibody sequences

| Description | Sequence | SEQ ID NO: |
|---|---|---|
| mAb2.7-HVR-H3 | TRVRYGVGVPRYFDP | 148 |
| mAb2.8-VH | ELQLQESGPGLVKPSETLSLTCTVSGGSISDSSYYWGWIRQPPGKGLEWIG SIYYTGETYYAPSLKSRVTISVDTSKNQFSLKLSSVTAADTAVYYCARLRY GVGVPRYFDPWGQGTLVTVSS | 149 |
| mAb2.8-HVR-H1 | SDSSYYW | 150 |
| mAb2.8-HVR-H2 | SIYYTGETYYAP | 151 |
| mAb2.8-HVR-H3 | ARLRYGVGVPRYFDP | 152 |
| mAb2.9-VH | ELQLQESGPGLVKPSETLSLTCTVSGGSISDSSYYWGWIRQPPGKGLEWIG SIYYTGETYYAPSLKSRVTISVDTSKNQFSLKLSSVTAADTAVYYCARVKY GVGVPRYFDPWGQGTLVTVSS | 153 |
| mAb2.9-HVR-H1 | SDSSYYW | 154 |
| mAb2.9-HVR-H2 | SIYYTGETYYAP | 155 |
| mAb2.9-HVR-H3 | ARVKYGVGVPRYFDP | 156 |
| mAb2.10-VH | ELQLQESGPGLVKPSETLSLTCTVSGGSISDSSYYWGWIRQPPGKGLEWIG SIYYTGETYYAPSLKSRVTISVDTSKNQFSLKLSSVTAADTAVYYCARVRY GVGVPRHFDPWGQGTLVTVSS | 157 |
| mAb2.10-HVR-H1 | SDSSYYW | 158 |
| mAb2.10-HVR-H2 | SIYYTGETYYAP | 159 |
| mAb2.10-HVR-H3 | ARVRYGVGVPRHFDP | 160 |
| mAb2.11-VH | ELQLQESGPGLVKPSETLSLTCTVSGGSISESSYYWGWIRQPPGKGLEWIG SIYYTGETYYAPSLKSRVTISVDTSKNQFSLKLSSVTAADTAVYYCARLRY GVGVPRYFDPWGQGTLVTVSS | 161 |
| mAb2.11-HVR-H1 | SESSYYW | 162 |
| mAb2.11-HVR-H2 | SIYYTGETYYAP | 163 |
| mAb2.11-HVR-H3 | ARLRYGVGVPRYFDP | 164 |
| mAb2.12-VH | ELQLQESGPGLVKPSETLSLTCTVSGGSISESSYYWGWIRQPPGKGLEWIG SIYYTGETYYAPSLKSRVTISVDTSKNQFSLKLSSVTAADTAVYYCARVKY GVGVPRYFDPWGQGTLVTVSS | 165 |
| mAb2.12-HVR-H1 | SESSYYW | 166 |
| mAb2.12-HVR-H2 | SIYYTGETYYAP | 167 |
| mAb2.12-HVR-H3 | ARVKYGVGVPRYFDP | 168 |
| mAb2, mAb6_2, and mAb6_2.7 and mAb2.10-LC | ESVLTQPPSVSGAPGQRVTISCTGSSSNIGAHYDVHWYQQLPGTAPKLLIY GNDNRPSGVPDRFSGSKSGTSASLAITGLQAEDEADYYCQSYDYSLSGYVF GGGTKLTVLGQPKAAPSVTLFPPSSEELQANKATLVCLISDFYPGAVTVAW KADSSPVKAGVETTTPSKQSNNKYAASSYLSLTPEQWKSHKSYSCQVTHEG STVEKTVAPTECS | 169 |
| mAb6-LC | ESVLTQPPSVSGAPGQRVTISCTGSSSNIGAGYDVHWYQQLPGTAPKLLIY GNTNRPSGVPDRFSGSKSGTSASLAITGLQAEDEADYYCQSYDISLSGWVF GGGTKLTVLGQPKAAPSVTLFPPSSEELQANKATLVCLISDFYPGAVTVAW KADSSPVKAGVETTTPSKQSNNKYAASSYLSLTPEQWKSHKSYSCQVTHEG STVEKTVAPTECS | 242 |
| MAb6.0-LC | QESVLTQPPSVSGAPGQRVTISCTGSSSNIGAGYDVHWYQQLPGTAPKLLI YGNTNRPSGVPDRFSGSKSGTSASLAITGLQAEDEADYYCQSYDISLSGWV FGGGTKLTVLGQPKAAPSVTLFPPSSEELQANKATLVCLISDFYPGAVTVA WKADSSPVKAGVETTTPSKQSNNKYAASSYLSLTPEQWKSHKSYSCQVTHE GSTVEKTVAPTECS | 247 |
| mAb6.0 and mAb6.0_2.0-HC | QLQLQESGPGLVKPSETLSLTCTVSGGSITSSNYYWGWIRQPPGKGLEWIG SIDYTGSTYYNPSLKSRVTISVDTSKNQFSLKLSSVTAADTAVYYCARGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI | 248 |

TABLE 2-continued

Anti-IL-36 antibody sequences

| Description | Sequence | SEQ ID NO: |
|---|---|---|
| | CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | |
| mAb6.0 and mAb6.0_2.0-HC (knob) | QLQLQESGPGLVKPSETLSLTCTVSGGSI<u>TSSNYYWG</u>WIRQPPGKGLEWIG<br>SIDYTGSTYYNPSLKSRVTISVDTSKNQF<u>SLKLSSV</u>TAADTAVYYC<u>ARGKY<br>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 249 |
| mAb6.0 and mAb6.0_2.0-HC (hole) | QLQLQESGPGLVKPSETLSLTCTVSGGSI<u>TSSNYYWG</u>WIRQPPGKGLEWIG<br>SIDYTGSTYYNPSLKSRVTISVDTSKNQF<u>SLKLSSV</u>TAADTAVYYC<u>ARGKY<br>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 250 |
| mAb6 and mAb6_2-HC | ELQLQESGPGLVKPSETLSLTCTVSGGSI<u>TSSNYYWG</u>WIRQPPGKGLEWIG<br>SIDYTGSTYYNPSLKSRVTISVDTSKNQF<u>SLKLSSV</u>TAADTAVYYC<u>ARGKY<br>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 170 |
| mAb6 and mAb6_2-HC (knob) | ELQLQESGPGLVKPSETLSLTCTVSGGSI<u>TSSNYYWG</u>WIRQPPGKGLEWIG<br>SIDYTGSTYYNPSLKSRVTISVDTSKNQF<u>SLKLSSV</u>TAADTAVYYC<u>ARGKY<br>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 171 |
| mAb6 and mAb6_2-HC (hole) | ELQLQESGPGLVKPSETLSLTCTVSGGSI<u>TSSNYYWG</u>WIRQPPGKGLEWIG<br>SIDYTGSTYYNPSLKSRVTISVDTSKNQF<u>SLKLSSV</u>TAADTAVYYC<u>ARGKY<br>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 172 |
| MAb6_2.1-HC | ELQLQESGPGLVKPSETLSLTCTVSGGSI<u>TSTNYYWG</u>WIRQPPGKGLEWIG<br>NIDYTGSTYYNASLKSRVTISVDTSKNQF<u>SLKLSSV</u>TAADTAVYYC<u>ATGKY<br>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 173 |
| MAb6_2.1-HC (knob) | ELQLQESGPGLVKPSETLSLTCTVSGGSI<u>TSTNYYWG</u>WIRQPPGKGLEWIG<br>NIDYTGSTYYNASLKSRVTISVDTSKNQF<u>SLKLSSV</u>TAADTAVYYC<u>ATGKY<br>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR | 174 |

TABLE 2-continued

Anti-IL-36 antibody sequences

| Description | Sequence | SEQ ID NO: |
|---|---|---|
| | VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | |
| MAb6_2.1-HC (hole) | ELQLQESGPGLVKPSETLSLTCTVSGGSITSTNYYWGWIRQPPGKGLEWIG<br>NIDYTGSTYYNASLKSRVTISVDTSKNQFSLKLSSVTAADTAVYYCATGKY<br>YETYLGFDVWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 175 |
| MAb6_2.2-HC | ELQLQESGPGLVKPSETLSLTCTVSGGSITSSNAYWGWIRQPPGKGLEWIG<br>SIDYTGSTAYNPSLKSRVTISVDTSKNQFSLKLSSVTAADTAVYYCAHGKY<br>YETYLGFDVWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 176 |
| MAb6_2.2-HC (knob) | ELQLQESGPGLVKPSETLSLTCTVSGGSITSSNAYWGWIRQPPGKGLEWIG<br>SIDYTGSTAYNPSLKSRVTISVDTSKNQFSLKLSSVTAADTAVYYCAHGKY<br>YETYLGFDVWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 177 |
| MAb6_2.2-HC (hole) | ELQLQESGPGLVKPSETLSLTCTVSGGSITSSNAYWGWIRQPPGKGLEWIG<br>SIDYTGSTAYNPSLKSRVTISVDTSKNQFSLKLSSVTAADTAVYYCAHGKY<br>YETYLGFDVWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 178 |
| MAb6_2.3-HC | ELQLQESGPGLVKPSETLSLTCTVSGGSITASNYYWGWIRQPPGKGLEWIG<br>SIDYTGSTYYNTSLKSRVTISVDTSKNQFSLKLSSVTAADTAVYYCATGKY<br>YETYLGFDVWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 179 |
| MAb6_2.3-HC (knob) | ELQLQESGPGLVKPSETLSLTCTVSGGSITASNYYWGWIRQPPGKGLEWIG<br>SIDYTGSTYYNTSLKSRVTISVDTSKNQFSLKLSSVTAADTAVYYCATGKY<br>YETYLGFDVWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 180 |
| MAb6_2.3-HC (hole) | ELQLQESGPGLVKPSETLSLTCTVSGGSITASNYYWGWIRQPPGKGLEWIG<br>SIDYTGSTYYNTSLKSRVTISVDTSKNQFSLKLSSVTAADTAVYYCATGKY<br>YETYLGFDVWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 181 |

TABLE 2-continued

Anti-IL-36 antibody sequences

| Description | Sequence | SEQ ID NO: |
|---|---|---|
| mAb6_2.4-HC | ELQLQESGPGLVKPSETLSLTCTVSGGSI<u>TASNYYWG</u>WIRQPPGKGLEWIG<br><u>SIDYTGSTYYNPSLKSRVTISVDTSKNQF</u>SLKLSSVTAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 182 |
| MAb6_2.4-HC (knob) | ELQLQESGPGLVKPSETLSLTCTVSGGSI<u>TASNYYWG</u>WIRQPPGKGLEWIG<br><u>SIDYTGSTYYNPSLKSRVTISVDTSKNQF</u>SLKLSSVTAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 183 |
| MAb6_2.4-HC (hole) | ELQLQESGPGLVKPSETLSLTCTVSGGSI<u>TASNYYWG</u>WIRQPPGKGLEWIG<br><u>SIDYTGSTYYNPSLKSRVTISVDTSKNQF</u>SLKLSSVTAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 184 |
| MAb6_2.5-HC | ELQLQESGPGLVKPSETLSLTCTVSGGSI<u>TASNYYWG</u>WIRQPPGKGLEWIG<br><u>SIDYTGSTYYEPSLKSRVTISVDTSKNQF</u>SLKLSSVTAADTAVYYC<u>ATGSY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 185 |
| MAb6_2.5-HC (knob) | ELQLQESGPGLVKPSETLSLTCTVSGGSI<u>TASNYYWG</u>WIRQPPGKGLEWIG<br><u>SIDYTGSTYYEPSLKSRVTISVDTSKNQF</u>SLKLSSVTAADTAVYYC<u>ATGSY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 186 |
| MAb6_2.5-HC (hole) | ELQLQESGPGLVKPSETLSLTCTVSGGSI<u>TASNYYWG</u>WIRQPPGKGLEWIG<br><u>SIDYTGSTYYEPSLKSRVTISVDTSKNQF</u>SLKLSSVTAADTAVYYC<u>ATGSY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 187 |
| MAb6_2.6-HC | ELQLQESGPGLVKPSETLSLTCTVSGGSI<u>TASNYYWG</u>WIRQPPGKGLEWIG<br><u>SIDYTGSTYYEPSLKSRVTISVDTSKNQF</u>SLKLSSVTAADTAVYYC<u>ATGNY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 188 |
| MAb6_2.6-HC (knob) | ELQLQESGPGLVKPSETLSLTCTVSGGSI<u>TASNYYWG</u>WIRQPPGKGLEWIG<br><u>SIDYTGSTYYEPSLKSRVTISVDTSKNQF</u>SLKLSSVTAADTAVYYC<u>ATGNY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI | 189 |

TABLE 2-continued

Anti-IL-36 antibody sequences

| Description | Sequence | SEQ ID NO: |
|---|---|---|
| | CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | |
| MAb6_2.6-HC (hole) | ELQLQESGPGLVKPSETLSLTCTVSGGSI<u>TASNYYW</u>GWIRQPPGKGLEWIG<br><u>SIDYTGSTYYEPSLKSR</u>VTISVDTSKNQF<u>SLKLSSV</u>TAADTAVYYC<u>ATGNY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 190 |
| MAb6_2.7-HC | ELQLQESGPGLVKPSETLSLTCTVSGGSI<u>TASNTYW</u>GWIRQPPGKGLEWIG<br><u>SIDYTGSTYYNPSLKSR</u>VTISVDTSKNQF<u>SLKLSSV</u>TAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 191 |
| MAb6_2.7-HC (knob) | ELQLQESGPGLVKPSETLSLTCTVSGGSI<u>TASNTYW</u>GWIRQPPGKGLEWIG<br><u>SIDYTGSTYYNPSLKSR</u>VTISVDTSKNQF<u>SLKLSSV</u>TAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 192 |
| MAb6_2.7-HC (hole) | ELQLQESGPGLVKPSETLSLTCTVSGGSI<u>TASNTYW</u>GWIRQPPGKGLEWIG<br><u>SIDYTGSTYYNPSLKSR</u>VTISVDTSKNQF<u>SLKLSSV</u>TAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 193 |
| MAb6_2.8-HC | ELQLQESGPGLVKPSETLSLTCTVSGGSI<u>TASNYYW</u>GWIRQPPGKGLEWIG<br><u>SIDYTGSTYYNPSLKSR</u>VTISVDTSKNQF<u>SLKLSSV</u>TAADTAVYYC<u>ASGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 194 |
| MAb6_2.8-HC (knob) | ELQLQESGPGLVKPSETLSLTCTVSGGSI<u>TASNYYW</u>GWIRQPPGKGLEWIG<br><u>SIDYTGSTYYNPSLKSR</u>VTISVDTSKNQF<u>SLKLSSV</u>TAADTAVYYC<u>ASGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 195 |
| MAb6_2.8-HC (hole) | ELQLQESGPGLVKPSETLSLTCTVSGGSI<u>TASNYYW</u>GWIRQPPGKGLEWIG<br><u>SIDYTGSTYYNPSLKSR</u>VTISVDTSKNQF<u>SLKLSSV</u>TAADTAVYYC<u>ASGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR | 196 |

TABLE 2-continued

Anti-IL-36 antibody sequences

| Description | Sequence | SEQ ID NO: |
|---|---|---|
| | VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | |
| MAb6_2.9-HC | ELQLQESGPGLVKPSETLSLTCTVSGGSIT<u>SSNYYWG</u>WIRQPPGKGLEWIG<br><u>SIDYTGSTYYNPSLKSRVTISVDTSKNQF</u>SLKLSSVTAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 197 |
| MAb6_2.9-HC<br>(knob) | ELQLQESGPGLVKPSETLSLTCTVSGGSIT<u>SSNYYWG</u>WIRQPPGKGLEWIG<br><u>SIDYTGSTYYNPSLKSRVTISVDTSKNQF</u>SLKLSSVTAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 198 |
| MAb6_2.9-HC<br>(hole) | ELQLQESGPGLVKPSETLSLTCTVSGGSIT<u>SSNYYWG</u>WIRQPPGKGLEWIG<br><u>SIDYTGSTYYNPSLKSRVTISVDTSKNQF</u>SLKLSSVTAADTAVYYC<u>ATGKY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 199 |
| MAb6_2.10-HC | ELQLQESGPGLVKPSETLSLTCTVSGGSIT<u>SSNYYWG</u>WIRQPPGKGLEWIG<br><u>SIDYTGSTYYQPSLKSRVTISVDTSKNQF</u>SLKLSSVTAADTAVYYC<u>ARGNY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLTCLVKGFYPSDIAVEWESNGQPENNYKTTPPVLDSDGS<br>FFLYSKLTVDKSRWQQGNVFSCSVMHEALHNHYTQKSLSLSPG | 200 |
| MAb6_2.10-HC<br>(knob) | ELQLQESGPGLVKPSETLSLTCTVSGGSIT<u>SSNYYWG</u>WIRQPPGKGLEWIG<br><u>SIDYTGSTYYQPSLKSRVTISVDTSKNQF</u>SLKLSSVTAADTAVYYC<u>ARGNY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLWCLVKGFYPSDIAVEWESNGQPENNYKTTPPVLDSDGS<br>FFLYSKLTVDKSRWQQGNVFSCSVMHEALHNHYTQKSLSLSPG | 201 |
| MAb6_2.10-HC<br>(hole) | ELQLQESGPGLVKPSETLSLTCTVSGGSIT<u>SSNYYWG</u>WIRQPPGKGLEWIG<br><u>SIDYTGSTYYQPSLKSRVTISVDTSKNQF</u>SLKLSSVTAADTAVYYC<u>ARGNY</u><br><u>YETYLGFDV</u>WGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYI<br>CNVNHKPSNTKVDKKVEPKSCDKTHTCPPCPAPELLGGPSVFLFPPKPKDT<br>LMISRTPEVTCVVVDVSHEDPEVKFNWYVDGVEVHNAKTKPREEQYGSTYR<br>VVSVLTVLHQDWLNGKEYKCKVSNKALPAPIEKTISKAKGQPREPQVYTLP<br>PSRDELTKNQVSLSCAVKGFYPSDIAVEWESNGQPENNYKTTPPVLDSDGS<br>FFLVSKLTVDKSRWQQGNVFSCSVMHEALHNHYTQKSLSLSPG | 202 |
| MAb2.0-HC | QLQLQESGPGLVKPSETLSLTCTVSGGS<u>ISTSSYYWG</u>WIRQPPGKGLEWIG<br><u>SIYYTGNTYYNPSLKSRVTISVDTSKNQF</u>SLKLSSVTAADTAVYYC<u>ARVRY</u><br><u>GVGVPRYFDP</u>WGQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 243 |

TABLE 2-continued

Anti-IL-36 antibody sequences

| Description | Sequence | SEQ ID NO: |
|---|---|---|
| MAb2.0-HC (knob) | QLQLQESGPGLVKPSETLSLTCTVSGGSISTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLWCLVKGFYPSDIAVEWESNGQPENNYKTTPPVLDSDG SFFLYSKLTVDKSRWQQGNVFSCSVMHEALHNHYTQKSLSLSPG | 244 |
| MAb2.0-HC (hole) | QLQLQESGPGLVKPSETLSLTCTVSGGSISTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLSCAVKGFYPSDIAVEWESNGQPENNYKTTPPVLDSDG SFFLVSKLTVDKSRWQQGNVFSCSVMHEALHNHYTQKSLSLSPG | 245 |
| mAb2.0 and mAb6.0_2.0-LC | QSVLTQPPSVSGAPGQRVTISCTGSSSNIGAHYDVHWYQQLPGTAPKLLIY GNDNRPSGVPDRFSGSKSGTSASLAITGLQAEDEADYYCQSYDYSLSGYVF GGGTKLTVLGQPKAAPSVTLFPPSSEELQANKATLVCLISDFYPGAVTVAW KADSSPVKAGVETTTPSKQSNNKYAASSYLSLTPEQWKSHKSYSCQVTHEG STVEKTVAPTECS | 246 |
| mAb2-HC | ELQLQESGPGLVKPSETLSLTCTVSGGSISTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 203 |
| MAb2-HC (knob) | ELQLQESGPGLVKPSETLSLTCTVSGGSISTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLWCLVKGFYPSDIAVEWESNGQPENNYKTTPPVLDSDG SFFLYSKLTVDKSRWQQGNVFSCSVMHEALHNHYTQKSLSLSPG | 204 |
| MAb2-HC (hole) | ELQLQESGPGLVKPSETLSLTCTVSGGSISTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLSCAVKGFYPSDIAVEWESNGQPENNYKTTPPVLDSDG SFFLVSKLTVDKSRWQQGNVFSCSVMHEALHNHYTQKSLSLSPG | 205 |
| mAb2.1-HC | ELQLQESGPGLVKPSETLSLTCTVSGGSIDSSYYWGWIRQPPGKGLEWIG SIYYTGNTYYNSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 206 |
| MAb2.1-HC (knob) | ELQLQESGPGLVKPSETLSLTCTVSGGSIDSSYYWGWIRQPPGKGLEWIG SIYYTGNTYYNSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY | 207 |

TABLE 2-continued

Anti-IL-36 antibody sequences

| Description | Sequence | SEQ ID NO: |
|---|---|---|
| | RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | |
| MAb2.1-HC (hole) | ELQLQESGPGLVKPSETLSLTCTVSGGSI<u>SDSSYYWG</u>WIRQPPGKGLEWIG<br><u>SIYYTGNTYYNS</u>SLKSRVTISVDTSKNQF<u>SLKLSSV</u>TAADTAVYYC<u>ARVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | 208 |
| mAb2.2-HC | ELQLQESGPGLVKPSETLSLTCTVSGGSI<u>SESSYYWG</u>WIRQPPGKGLEWIG<br><u>SIYYTGNTYYNP</u>SLKSRVTISVDTSKNQF<u>SLKLSSV</u>TAADTAVYYC<u>AGVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 209 |
| MAb2.2-HC (knob) | ELQLQESGPGLVKPSETLSLTCTVSGGSI<u>SESSYYWG</u>WIRQPPGKGLEWIG<br><u>SIYYTGNTYYNP</u>SLKSRVTISVDTSKNQF<u>SLKLSSV</u>TAADTAVYYC<u>AGVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 210 |
| MAb2.2-HC (hole) | ELQLQESGPGLVKPSETLSLTCTVSGGSI<u>SESSYYWG</u>WIRQPPGKGLEWIG<br>SIYYTGNTYYNPSLKSRVTISVDTSKNQF<u>SLKLSSV</u>TAADTAVYYCAGVRY<br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | 211 |
| MAb2.3-HC | ELQLQESGPGLVKPSETLSLTCTVSGGSI<u>STSSDYWG</u>WIRQPPGKGLEWIG<br>SIYYTGNTYYLPSLKSRVTISVDTSKNQF<u>SLKLSSV</u>TAADTAVYYC<u>SRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 212 |
| MAb2.3-HC (knob) | ELQLQESGPGLVKPSETLSLTCTVSGGSI<u>STSSDYWG</u>WIRQPPGKGLEWIG<br><u>SIYYTGNTYYLP</u>SLKSRVTISVDTSKNQF<u>SLKLSSV</u>TAADTAVYYC<u>SRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 213 |
| MAb2.3-HC (hole) | ELQLQESGPGLVKPSETLSLTCTVSGGSI<u>STSSDYWG</u>WIRQPPGKGLEWIG<br><u>SIYYTGNTYYLP</u>SLKSRVTISVDTSKNQF<u>SLKLSSV</u>TAADTAVYYC<u>SRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | 214 |

TABLE 2-continued

Anti-IL-36 antibody sequences

| Description | Sequence | SEQ ID NO: |
|---|---|---|
| MAb2.4-HC | ELQLQESGPGLVKPSETLSLTCTVSGGSI<u>SNSSYYWG</u>WIRQPPGKGLEWIG<br><u>SIYYTGNTYYLP</u>SLKSRVTISVDTSKNQF<u>SLKLSSV</u>TAADTAVYYC<u>ARVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 215 |
| MAb2.4-HC (knob) | ELQLQESGPGLVKPSETLSLTCTVSGGSI<u>SNSSYYWG</u>WIRQPPGKGLEWIG<br><u>SIYYTGNTYYLP</u>SLKSRVTISVDTSKNQF<u>SLKLSSV</u>TAADTAVYYC<u>ARVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 216 |
| MAb2.4-HC (hole) | ELQLQESGPGLVKPSETLSLTCTVSGGSI<u>SNSSYYWG</u>WIRQPPGKGLEWIG<br><u>SIYYTGNTYYLP</u>SLKSRVTISVDTSKNQF<u>SLKLSSV</u>TAADTAVYYC<u>ARVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLYSKLTVDKSRWQQGNVFSCSVMHEALHNHYTQKSLSLSPG | 217 |
| MAb2.5-HC | ELQLQESGPGLVKPSETLSLTCTVSGGSI<u>SESSYYWG</u>WIRQPPGKGLEWIG<br><u>SIYYTGNTYYLP</u>SLKSRVTISVDTSKNQF<u>SLKLSSV</u>TAADTAVYYC<u>ARVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 218 |
| MAb2.5-HC (knob) | ELQLQESGPGLVKPSETLSLTCTVSGGSI<u>SESSYYWG</u>WIRQPPGKGLEWIG<br><u>SIYYTGNTYYLP</u>SLKSRVTISVDTSKNQF<u>SLKLSSV</u>TAADTAVYYC<u>ARVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 219 |
| MAb2.5-HC (hole) | ELQLQESGPGLVKPSETLSLTCTVSGGSI<u>SESSYYWG</u>WIRQPPGKGLEWIG<br><u>SIYYTGNTYYLP</u>SLKSRVTISVDTSKNQF<u>SLKLSSV</u>TAADTAVYYC<u>ARVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLYSKLTVDKSRWQQGNVFSCSVMHEALHNHYTQKSLSLSPG | 220 |
| MAb2.6-HC | ELQLQESGPGLVKPSETLSLTCTVSGGSI<u>STSSYHWG</u>WIRQPPGKGLEWIG<br><u>SIYYTGNTYYMP</u>SLKSRVTISVDTSKNQF<u>SLKLSSV</u>TAADTAVYYC<u>VRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 221 |
| MAb2.6-HC (knob) | ELQLQESGPGLVKPSETLSLTCTVSGGSI<u>STSSYHWG</u>WIRQPPGKGLEWIG<br><u>SIYYTGNTYYMP</u>SLKSRVTISVDTSKNQF<u>SLKLSSV</u>TAADTAVYYC<u>VRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY | 222 |

TABLE 2-continued

Anti-IL-36 antibody sequences

| Description | Sequence | SEQ ID NO: |
|---|---|---|
| | ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | |
| MAb2.6-HC (hole) | ELQLQESGPGLVKPSETLSLTCTVSGGSI<u>STSSYHW</u>GWIRQPPGKGLEWIG<br><u>SIYYTGNTYYMPSLKSRVTISVDTSKNF</u>SLKLSSVTAADTAVYYC<u>VRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | 223 |
| MAb2.7-HC | ELQLQESGPGLVKPSETLSLTCTVSGGSI<u>SRSSYYW</u>GWIRQPPGKGLEWIG<br><u>SIYYTGNTYYWPSLKSRVTISVDTSKNF</u>SLKLSSVTAADTAVYYC<u>TRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 224 |
| MAb2.7-HC (knob) | ELQLQESGPGLVKPSETLSLTCTVSGGSI<u>SRSSYYW</u>GWIRQPPGKGLEWIG<br><u>SIYYTGNTYYWPSLKSRVTISVDTSKNF</u><u>SLKLSSVTAADTAVYYC</u><u>TRVRY</u><br><u>GVGVPRYFDPW</u>GQGTLVTVSSASTKGPSVFPLAPSSKSTSGGTAAL<u>GCLVK</u><br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 225 |
| MAb2.7-HC (hole) | ELQLQESGPGLVKPSETLSLTCTVSGGSI<u>SRSSYYW</u>GWIRQPPGKGLEWIG<br><u>SIYYTGNTYYWPSLKSRVTISVDTSKNF</u><u>SLKLSSVTAADTAVYYC</u><u>TRVRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | 226 |
| MAb2.8-HC | ELQLQESGPGLVKPSETLSLTCTVSGGSI<u>SDSSYYW</u>GWIRQPPGKGLEWIG<br>SIYYTGETYYAPSLKSRVTISVDTSKNF<u>SLKLSSVTAADTAVYYC</u><u>ARLRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 227 |
| MAb2.8-HC (knob) | ELQLQESGPGLVKPSETLSLTCTVSGGSI<u>SDSSYYW</u>GWIRQPPGKGLEWIG<br>SIYYTGETYYAPSLKSRVTISVDTSKNF<u>SLKLSSVTAADTAVYYC</u><u>ARLRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 228 |
| MAb2.8-HC (hole) | ELQLQESGPGLVKPSETLSLTCTVSGGSI<u>SDSSYYW</u>GWIRQPPGKGLEWIG<br>SIYYTGETYYAPSLKSRVTISVDTSKNF<u>SLKLSSVTAADTAVYYC</u><u>ARLRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY | 229 |

TABLE 2-continued

Anti-IL-36 antibody sequences

| Description | Sequence | SEQ ID NO: |
|---|---|---|
| | RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | |
| MAb2.9-HC | ELQLQESGPGLVKPSETLSLTCTVSGGSI<u>SDSSYYWG</u>WIRQPPGKGLEWIG<br><u>SIYYTGETYYAP</u>SLKSRVTISVDTSKNQF<u>SLKLSS</u>VTAADTAVYYC<u>ARVKY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 230 |
| MAb2.9-HC (knob) | ELQLQESGPGLVKPSETLSLTCTVSGGSI<u>SDSSYYWG</u>WIRQPPGKGLEWIG<br><u>SIYYTGETYYAP</u>SLKSRVTISVDTSKNQF<u>SLKLSS</u>VTAADTAVYYC<u>ARVKY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 231 |
| MAb2.9-HC (hole) | ELQLQESGPGLVKPSETLSLTCTVSGGSI<u>SDSSYYWG</u>WIRQPPGKGLEWIG<br><u>SIYYTGETYYAP</u>SLKSRVTISVDTSKNQF<u>SLKLSS</u>VTAADTAVYYC<u>ARVKY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | 232 |
| MAb2.10-HC | ELQLQESGPGLVKPSETLSLTCTVSGGSI<u>SDSSYYWG</u>WIRQPPGKGLEWIG<br><u>SIYYTGETYYAP</u>SLKSRVTISVDTSKNQF<u>SLKLSS</u>VTAADTAVYYC<u>ARVRY</u><br><u>GVGVPRHFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 233 |
| MAb2.10-HC (knob) | ELQLQESGPGLVKPSETLSLTCTVSGGSI<u>SDSSYYWG</u>WIRQPPGKGLEWIG<br><u>SIYYTGETYYAP</u>SLKSRVTISVDTSKNQF<u>SLKLSS</u>VTAADTAVYYC<u>ARVRY</u><br><u>GVGVPRHFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 234 |
| MAb2.10-HC (hole) | ELQLQESGPGLVKPSETLSLTCTVSGGSI<u>SDSSYYWG</u>WIRQPPGKGLEWIG<br><u>SIYYTGETYYAP</u>SLKSRVTISVDTSKNQF<u>SLKLSS</u>VTAADTAVYYC<u>ARVRY</u><br><u>GVGVPRHFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLVSKLTVDKSRWQQGNVFSCSVMHEALHNHYTQKSLSLSPG | 235 |
| MAb2.11-HC | ELQLQESGPGLVKPSETLSLTCTVSGGSI<u>SESSYYWG</u>WIRQPPGKGLEWIG<br><u>SIYYTGETYYAP</u>SLKSRVTISVDTSKNQF<u>SLKLSS</u>VTAADTAVYYC<u>ARLRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 236 |

TABLE 2-continued

Anti-IL-36 antibody sequences

| Description | Sequence | SEQ ID NO: |
|---|---|---|
| MAb2.11-HC (knob) | ELQLQESGPGLVKPSETLSLTCTVSGGSI<u>SESSYYW</u>GWIRQPPGKGLEWIG<br><u>SIYYTGETYYAPS</u>LKSRVTISVDTSKNQF<u>SLKLSSV</u>TAADTAVYYC<u>ARLRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 237 |
| MAb2.11-HC (hole) | ELQLQESGPGLVKPSETLSLTCTVSGGSI<u>SESSYYW</u>GWIRQPPGKGLEWIG<br><u>SIYYTGETYYAPS</u>LKSRVTISVDTSKNQF<u>SLKLSSV</u>TAADTAVYYC<u>ARLRY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLYSKLTVDKSRWQQGNVFSCSVMHEALHNHYTQKSLSLSPG | 238 |
| MAb2.12-HC | ELQLQESGPGLVKPSETLSLTCTVSGGSI<u>SESSYYW</u>GWIRQPPGKGLEWIG<br><u>SIYYTGETYYAPS</u>LKSRVTISVDTSKNQF<u>SLKLSSV</u>TAADTAVYYC<u>ARVKY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLTCLVKGFYPSDIAVEWESNGQPENNYKTTPPVLDSDG<br>SFFLYSKLTVDKSRWQQGNVFSCSVMHEALHNHYTQKSLSLSPG | 239 |
| mAb2.12-HC (knob) | ELQLQESGPGLVKPSETLSLTCTVSGGSI<u>SESSYYW</u>GWIRQPPGKGLEWIG<br><u>SIYYTGETYYAPS</u>LKSRVTISVDTSKNQF<u>SLKLSSV</u>TAADTAVYYC<u>ARVKY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLWCLVKGFYPSDIAVEWESNGQPENNYKTTPPVLDSDG<br>SFFLYSKLTVDKSRWQQGNVFSCSVMHEALHNHYTQKSLSLSPG | 240 |
| MAb2.12-HC (hole) | ELQLQESGPGLVKPSETLSLTCTVSGGSI<u>SESSYYW</u>GWIRQPPGKGLEWIG<br><u>SIYYTGETYYAPS</u>LKSRVTISVDTSKNQF<u>SLKLSSV</u>TAADTAVYYC<u>ARVKY</u><br><u>GVGVPRYFDPW</u>GQGTLVTVSSASTKGPSVFPLAPSSKSTSGGTAALGCLVK<br>DYFPEPVTVSWNSGALTSGVHTFPAVLQSSGLYSLSSVVTVPSSSLGTQTY<br>ICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPREEQYGSTY<br>RVVSVLTVLHQDWLNGKEYKCKVSNKALPAPIEKTISKAKGQPREPQVYTL<br>PPSRDELTKNQVSLSCAVKGFYPSDIAVEWESNGQPENNYKTTPPVLDSDG<br>SFFLYSKLTVDKSRWQQGNVFSCSVMHEALHNHYTQKSLSLSPG | 241 |
| mAb6_2-HVR-H1-generic | XXXNXYX<br>X at position 1 is T, D, E, or N; X at position 2 is S, A, E, G, K, Q, R, or T; X at position 3 is S, A, D, E, G, N, P, Q, or T; X at position 5 is Y, A, E, G, H, M, N, Q, S, T, or V; X at position 7 is W, F, I, V, or Y. | 251 |
| mAb6_2-HVR-H1-T30D | DSSNYYW | 252 |
| mAb6_2-HVR-H1-T30E | ESSNYYW | 253 |
| mAb6_2-HVR-H1-T30N | NSSNYYW | 254 |
| mAb6_2-HVR-H1-S31A | TASNYYW | 255 |
| mAb6_2-HVR-H1-S31E | TESNYYW | 256 |
| mAb6_2-HVR-H1-S31G | TGSNYYW | 257 |
| mAb6_2-HVR-H1-S31K | TKSNYYW | 258 |
| mAb6_2-HVR-H1-S31Q | TQSNYYW | 259 |

TABLE 2-continued

Anti-IL-36 antibody sequences

| Description | Sequence | SEQ ID NO: |
|---|---|---|
| mAb6_2-HVR-H1-S31R | TRSNYYW | 260 |
| mAb6_2-HVR-H1-S31T | TTSNYYW | 261 |
| mAb6_2-HVR-H1-S32A | TSANYYW | 262 |
| mAb6_2-HVR-H1-S32D | TSDNYYW | 263 |
| mAb6_2-HVR-H1-S32E | TSENYYW | 264 |
| mAb6_2-HVR-H1-S32G | TSGNYYW | 265 |
| mAb6_2-HVR-H1-S32N | TSNNYYW | 266 |
| mAb6_2-HVR-H1-S32P | TSPNYYW | 267 |
| mAb6_2-HVR-H1-S32Q | TSQNYYW | 268 |
| mAb6_2-HVR-H1-S32T | TSTNYYW | 269 |
| mAb6_2-HVR-H1-Y34A | TSSNAYW | 270 |
| mAb6_2-HVR-H1-Y34E | TSSNEYW | 271 |
| mAb6_2-HVR-H1-Y34G | TSSNGYW | 272 |
| mAb6_2-HVR-H1-Y34H | TSSNHYW | 273 |
| mAb6_2-HVR-H1-Y34M | TSSNMYW | 274 |
| mAb6_2-HVR-H1-Y34N | TSSNNYW | 275 |
| mAb6_2-HVR-H1-Y34Q | TSSNQYW | 276 |
| mAb6_2-HVR-H1-Y34S | TSSNSYW | 277 |
| mAb6_2-HVR-H1-Y34T | TSSNTYW | 278 |
| mAb6_2-HVR-H1-Y34V | TSSNVYW | 279 |
| mAb6_2-HVR-H1-W35aF | TSSNYYF | 280 |
| mAb6_2-HVR-H1-W35aI | TSSNYYI | 281 |
| mAb6_2-HVR-H1-W35aV | TSSNYYV | 282 |
| mAb6_2-HVR-H1-W35aY | TSSNYYY | 283 |
| mAb6_2-HVR-H2-generic | XXDXXXXXXYXX X at position 1 is S, N, or T; X at position 2 is I, M, or V; X at position 4 is Y, or H; X at position 5 is T, H, L, or N; X at position 6 is G, A, D, E, H, K, N, Q, R, S, or T; X at position 7 is S, A, D, Q, or T; X at position 8 is T, A, D, or E; X at position 9 is Y, A, F, Q, S, or W; X at position 11 is N, D, E, H, P, or Q; X at position 12 is P, A, or E. | 284 |
| mAb6_2-HVR-H2-S50N | NIDYTGSTYYNP | 285 |
| mAb6_2-HVR-H2-S50T | TIDYTGSTYYNP | 286 |
| mAb6_2-HVR-H2-I51M | SMDYTGSTYYNP | 287 |
| mAb6_2-HVR-H2-I51V | SVDYTGSTYYNP | 288 |
| mAb6_2-HVR-H2-Y53H | SIDHTGSTYYNP | 289 |
| mAb6_2-HVR-H2-T54H | SIDYHGSTYYNP | 290 |
| mAb6_2-HVR-H2-T54L | SIDYLGSTYYNP | 291 |

TABLE 2-continued

Anti-IL-36 antibody sequences

| Description | Sequence | SEQ ID NO: |
|---|---|---|
| mAb6_2-HVR-H2-T54N | SIDYNGSTYYNP | 292 |
| mAb6_2-HVR-H2-G55A | SIDYTASTYYNP | 293 |
| mAb6_2-HVR-H2-G55D | SIDYTDSTYYNP | 294 |
| mAb6_2-HVR-H2-G55E | SIDYTESTYYNP | 295 |
| mAb6_2-HVR-H2-G55H | SIDYTHSTYYNP | 296 |
| mAb6_2-HVR-H2-G55K | SIDYTKSTYYNP | 297 |
| mAb6_2-HVR-H2-G55N | SIDYTNSTYYNP | 298 |
| mAb6_2-HVR-H2-G55Q | SIDYTQSTYYNP | 299 |
| mAb6_2-HVR-H2-G55R | SIDYTRSTYYNP | 300 |
| mAb6_2-HVR-H2-G55S | SIDYTSSTYYNP | 301 |
| mAb6_2-HVR-H2-G55T | SIDYTTSTYYNP | 302 |
| mAb6_2-HVR-H2-S56A | SIDYTGATYYNP | 303 |
| mAb6_2-HVR-H2-S56D | SIDYTGDTYYNP | 304 |
| mAb6_2-HVR-H2-S56Q | SIDYTGQTYYNP | 305 |
| mAb6_2-HVR-H2-S56T | SIDYTGTTYYNP | 306 |
| mAb6_2-HVR-H2-T57A | SIDYTGSAYYNP | 307 |
| mAb6_2-HVR-H2-T57D | SIDYTGSDYYNP | 308 |
| mAb6_2-HVR-H2-T57E | SIDYTGSEYYNP | 309 |
| mAb6_2-HVR-H2-Y58A | SIDYTGSTAYNP | 310 |
| mAb6_2-HVR-H2-Y58F | SIDYTGSTFYNP | 311 |
| mAb6_2-HVR-H2-Y58Q | SIDYTGSTQYNP | 312 |
| mAb6_2-HVR-H2-Y58S | SIDYTGSTSYNP | 313 |
| mAb6_2-HVR-H2-Y58W | SIDYTGSTWYNP | 314 |
| mAb6_2-HVR-H2-N60D | SIDYTGSTYYDP | 315 |
| mAb6_2-HVR-H2-N60E | SIDYTGSTYYEP | 316 |
| mAb6_2-HVR-H2-N60H | SIDYTGSTYYHP | 317 |
| mAb6_2-HVR-H2-N60P | SIDYTGSTYYPP | 318 |
| mAb6_2-HVR-H2-N60Q | SIDYTGSTYYQP | 319 |
| mAb6_2-HVR-H2-P61A | SIDYTGSTYYNA | 320 |
| mAb6_2-HVR-H2-P61E | SIDYTGSTYYNE | 321 |
| mAb6_2-HVR-H3-generic | AXGXYYXTYLGFDV<br>X at position 2 is R, A, E, G, H, M, N, Q, S, T, or Y; X at position 4 is K, A, or S; X at position 7 is E or T. | 322 |
| mAb6_2-HVR-H3-R94A | AAGKYYETYLGFDV | 323 |
| mAb6_2-HVR-H3-R94E | AEGKYYETYLGFDV | 324 |
| mAb6_2-HVR-H3-R94G | AGGKYYETYLGFDV | 325 |
| mAb6_2-HVR-H3-R94H | AHGKYYETYLGFDV | 326 |
| mAb6_2-HVR-H3-R94M | AMGKYYETYLGFDV | 327 |

TABLE 2-continued

Anti-IL-36 antibody sequences

| Description | Sequence | SEQ ID NO: |
|---|---|---|
| mAb6_2-HVR-H3-R94N | ANGKYYETYLGFDV | 328 |
| mAb6_2-HVR-H3-R94Q | AQGKYYETYLGFDV | 329 |
| mAb6_2-HVR-H3-R94S | ASGKYYETYLGFDV | 330 |
| mAb6_2-HVR-H3-R94T | ATGKYYETYLGFDV | 331 |
| mAb6_2-HVR-H3-R94Y | AYGKYYETYLGFDV | 332 |
| mAb6_2-HVR-H3-K96A | ARGAYYETYLGFDV | 333 |
| mAb6_2-HVR-H3-K96S | ARGSYYETYLGFDV | 334 |
| mAb6_2-HVR-H3-E99T | ARGKYYTTYLGFDV | 335 |
| mAb2-HVR-H1-generic | XXXXXXW  X at position 1 is S or D; X at position 2 is T, A, D, E, G, H, K, N, P, Q, R, or S; X at position 3 is S, D, E, G, K, N, P, or R; X at position 4 is S, G, K, N, or P; X at position 5 is Y, A, D, E, G, H, M, N, Q, S, T, V, or W; X at position 6 is Y, A, F, G, H, M, N, or Q. | 336 |
| mAb2-HVR-H1-S30D | DTSSYYW | 337 |
| mAb2-HVR-H1-T31A | SASSYYW | 338 |
| mAb2-HVR-H1-T31D | SDSSYYW | 339 |
| mAb2-HVR-H1-T31E | SESSYYW | 340 |
| mAb2-HVR-H1-T31G | SGSSYYW | 341 |
| mAb2-HVR-H1-T31H | SHSSYYW | 342 |
| mAb2-HVR-H1-T31K | SKSSYYW | 343 |
| mAb2-HVR-H1-T31N | SNSSYYW | 344 |
| mAb2-HVR-H1-T31P | SPSSYYW | 345 |
| mAb2-HVR-H1-T31Q | SQSSYYW | 346 |
| mAb2-HVR-H1-T31R | SRSSYYW | 347 |
| mAb2-HVR-H1-T31S | SSSSYYW | 348 |
| mAb2-HVR-H1-S32D | STDSYYW | 349 |
| mAb2-HVR-H1-S32E | STESYYW | 350 |
| mAb2-HVR-H1-S32G | STGSYYW | 351 |
| mAb2-HVR-H1-S32K | STKSYYW | 352 |
| mAb2-HVR-H1-S32N | STNSYYW | 353 |
| mAb2-HVR-H1-S32P | STPSYYW | 354 |
| mAb2-HVR-H1-S32R | STRSYYW | 355 |
| mAb2-HVR-H1-S33G | STSGYYW | 356 |
| mAb2-HVR-H1-S33K | STSKYYW | 357 |
| mAb2-HVR-H1-S33N | STSNYYW | 358 |
| mAb2-HVR-H1-S33P | STSPYYW | 359 |
| mAb2-HVR-H1-Y34A | STSSAYW | 360 |

TABLE 2-continued

Anti-IL-36 antibody sequences

| Description | Sequence | SEQ ID NO: |
|---|---|---|
| mAb2-HVR-H1-Y34D | STSSDYW | 361 |
| mAb2-HVR-H1-Y34E | STSSEYW | 362 |
| mAb2-HVR-H1-Y34G | STSSGYW | 363 |
| mAb2-HVR-H1-Y34H | STSSHYW | 364 |
| mAb2-HVR-H1-Y34M | STSSMYW | 365 |
| mAb2-HVR-H1-Y34N | STSSNYW | 366 |
| mAb2-HVR-H1-Y34Q | STSSQYW | 367 |
| mAb2-HVR-H1-Y34S | STSSSYW | 368 |
| mAb2-HVR-H1-Y34T | STSSTYW | 369 |
| mAb2-HVR-H1-Y34V | STSSVYW | 370 |
| mAb2-HVR-H1-Y34W | STSSWYW | 371 |
| mAb2-HVR-H1-Y35A | STSSYAW | 372 |
| mAb2-HVR-H1-Y35F | STSSYFW | 373 |
| mAb2-HVR-H1-Y35G | STSSYGW | 374 |
| mAb2-HVR-H1-Y35H | STSSYHW | 375 |
| mAb2-HVR-H1-Y35M | STSSYMW | 376 |
| mAb2-HVR-H1-Y35N | STSSYNW | 377 |
| mAb2-HVR-H1-Y35Q | STSSYQW | 378 |
| mAb2-HVR-H2-generic | XXXXXXXXXYXP X at position 1 is S, F, I, M, or Q; X at position 2 is I, A, G, L, R, S, T, or V; X at position 3 is Y, A, D, E, F, G, H, K, L, M, N, P, Q, R, S, T, or W; X at position 4 is Y, A, D, E, F, G, H, K, N, P, Q, R, S, T, or W; X at position 5 is T, D, E, K, N, P, or Q; X at position 6 is G or Q; X at position 7 is N, D, E, G, H, I, K, M, P, R, or S; X at position 8 is T, A, E, F, G, H, K, P, Q, R, S, V, W, or Y; X at position 9 is Y or W; X at position 11 is N, A, D, E, K, L, M, P, Q, S or T. | 379 |
| mAb2-HVR-H2-S50F | FIYYTGNTYYNP | 380 |
| mAb2-HVR-H2-S50I | IIYYTGNTYYNP | 381 |
| mAb2-HVR-H2-S50M | MIYYTGNTYYNP | 382 |
| mAb2-HVR-H2-S50Q | QIYYTGNTYYNP | 383 |
| mAb2-HVR-H2-I51A | SAYYTGNTYYNP | 384 |
| mAb2-HVR-H2-I51G | SGYYTGNTYYNP | 385 |
| mAb2-HVR-H2-I51L | SLYYTGNTYYNP | 386 |
| mAb2-HVR-H2-I51R | SRYYTGNTYYNP | 387 |
| mAb2-HVR-H2-I51S | SSYYTGNTYYNP | 388 |
| mAb2-HVR-H2-151T | STYYTGNTYYNP | 389 |
| mAb2-HVR-H2-I51V | SVYYTGNTYYNP | 390 |
| mAb2-HVR-H2-Y52A | SIAYTGNTYYNP | 391 |

TABLE 2-continued

Anti-IL-36 antibody sequences

| Description | Sequence | SEQ ID NO: |
|---|---|---|
| mAb2-HVR-H2-Y52D | SIDYTGNTYYNP | 392 |
| mAb2-HVR-H2-Y52E | SIEYTGNTYYNP | 393 |
| mAb2-HVR-H2-Y52F | SIFYTGNTYYNP | 394 |
| mAb2-HVR-H2-Y52G | SIGYTGNTYYNP | 395 |
| mAb2-HVR-H2-Y52H | SIHYTGNTYYNP | 396 |
| mAb2-HVR-H2-Y52K | SIKYTGNTYYNP | 397 |
| mAb2-HVR-H2-Y52L | SILYTGNTYYNP | 398 |
| mAb2-HVR-H2-Y52M | SIMYTGNTYYNP | 399 |
| mAb2-HVR-H2-Y52N | SINYTGNTYYNP | 400 |
| mAb2-HVR-H2-Y52P | SIPYTGNTYYNP | 401 |
| mAb2-HVR-H2-Y52Q | SIQYTGNTYYNP | 402 |
| mAb2-HVR-H2-Y52R | SIRYTGNTYYNP | 403 |
| mAb2-HVR-H2-Y52S | SISYTGNTYYNP | 404 |
| mAb2-HVR-H2-Y52T | SITYTGNTYYNP | 405 |
| mAb2-HVR-H2-Y52W | SIWYTGNTYYNP | 406 |
| mAb2-HVR-H2-Y53A | SIYATGNTYYNP | 407 |
| mAb2-HVR-H2-Y53D | SIYDTGNTYYNP | 408 |
| mAb2-HVR-H2-Y53E | SIYETGNTYYNP | 409 |
| mAb2-HVR-H2-Y53F | SIYFTGNTYYNP | 410 |
| mAb2-HVR-H2-Y53G | SIYGTGNTYYNP | 411 |
| mAb2-HVR-H2-Y53H | SIYHTGNTYYNP | 412 |
| mAb2-HVR-H2-Y53K | SIYKTGNTYYNP | 413 |
| mAb2-HVR-H2-Y53N | SIYNTGNTYYNP | 414 |
| mAb2-HVR-H2-Y53P | SIYPTGNTYYNP | 415 |
| mAb2-HVR-H2-Y53Q | SIYQTGNTYYNP | 416 |
| mAb2-HVR-H2-Y53R | SIYRTGNTYYNP | 417 |
| mAb2-HVR-H2-Y53S | SIYSTGNTYYNP | 418 |
| mAb2-HVR-H2-Y53T | SIYTTGNTYYNP | 419 |
| mAb2-HVR-H2-Y53W | SIYWTGNTYYNP | 420 |
| mAb2-HVR-H2-T54D | SIYYDGNTYYNP | 421 |
| mAb2-HVR-H2-T54E | SIYYEGNTYYNP | 422 |
| mAb2-HVR-H2-T54K | SIYYKGNTYYNP | 423 |
| mAb2-HVR-H2-T54N | SIYYNGNTYYNP | 424 |
| mAb2-HVR-H2-T54P | SIYYPGNTYYNP | 425 |
| mAb2-HVR-H2-T54Q | SIYYQGNTYYNP | 426 |
| mAb2-HVR-H2-G55Q | SIYYTQNTYYNP | 427 |
| mAb2-HVR-H2-N56D | SIYYTGDTYYNP | 428 |

TABLE 2-continued

| Anti-IL-36 antibody sequences | | |
|---|---|---|
| Description | Sequence | SEQ ID NO: |
| mAb2-HVR-H2-N56E | SIYYTGETYYNP | 429 |
| mAb2-HVR-H2-N56G | SIYYTGGTYYNP | 430 |
| mAb2-HVR-H2-N56H | SIYYTGHTYYNP | 431 |
| mAb2-HVR-H2-N56I | SIYYTGITYYNP | 432 |
| mAb2-HVR-H2-N56K | SIYYTGKTYYNP | 433 |
| mAb2-HVR-H2-N56M | SIYYTGMTYYNP | 434 |
| mAb2-HVR-H2-N56P | SIYYTGPTYYNP | 435 |
| mAb2-HVR-H2-N56R | SIYYTGRTYYNP | 436 |
| mAb2-HVR-H2-N56S | SIYYTGSTYYNP | 437 |
| mAb2-HVR-H2-T57A | SIYYTGNAYYNP | 438 |
| mAb2-HVR-H2-T57E | SIYYTGNEYYNP | 439 |
| mAb2-HVR-H2-T57F | SIYYTGNFYYNP | 440 |
| mAb2-HVR-H2-T57G | SIYYTGNGYYNP | 441 |
| mAb2-HVR-H2-T57H | SIYYTGNHYYNP | 442 |
| mAb2-HVR-H2-T57K | SIYYTGNKYYNP | 443 |
| mAb2-HVR-H2-T57P | SIYYTGNPYYNP | 444 |
| mAb2-HVR-H2-T57Q | SIYYTGNQYYNP | 445 |
| mAb2-HVR-H2-T57R | SIYYTGNRYYNP | 446 |
| mAb2-HVR-H2-T57S | SIYYTGNSYYNP | 447 |
| mAb2-HVR-H2-T57V | SIYYTGNVYYNP | 448 |
| mAb2-HVR-H2-T57W | SIYYTGNWYYNP | 449 |
| mAb2-HVR-H2-T57Y | SIYYTGNYYYNP | 450 |
| mAb2-HVR-H2-Y58W | SIYYTGNTWYNP | 451 |
| mAb2-HVR-H2-N60A | SIYYTGNTYYAP | 452 |
| mAb2-HVR-H2-N60D | SIYYTGNTYYDP | 453 |
| mAb2-HVR-H2-N60E | SIYYTGNTYYEP | 454 |
| mAb2-HVR-H2-N60K | SIYYTGNTYYKP | 455 |
| mAb2-HVR-H2-N60L | SIYYTGNTYYLP | 456 |
| mAb2-HVR-H2-N60M | SIYYTGNTYYMP | 457 |
| mAb2-HVR-H2-N60P | SIYYTGNTYYPP | 458 |
| mAb2-HVR-H2-N60Q | SIYYTGNTYYQP | 459 |
| mAb2-HVR-H2-N60S | SIYYTGNTYYSP | 460 |
| mAb2-HVR-H2-N60T | SIYYTGNTYYTP | 461 |
| mAb2-HVR-H3-generic | XXXXXGXXVPRXFDP<br>X at position 1 is A or V; X at position 2 is R, A, G, N, Q, or T; X at position 3 is V, A, F, I, K, L, M, Q, or S; X at position 4 is R, A, I, K, L, M, P, Q, S, T, or V; X at position 5 is Y, H, I, L, or V; | 462 |

TABLE 2-continued

Anti-IL-36 antibody sequences

| Description | Sequence | SEQ ID NO: |
|---|---|---|
| | X at position 7 is V, A, F, G, K, M, N, Q, R, S, T, W, or Y; X at position 8 is G, N, R, S, or T; X at position 12 is Y, F, H, I, L, M, Q, or R. | |
| mAb2-HVR-H3-A93V | VRVRYGVGVPRYFDP | 463 |
| mAb2-HVR-H3-R94A | AAVRYGVGVPRYFDP | 464 |
| mAb2-HVR-H3-R94G | AGVRYGVGVPRYFDP | 465 |
| mAb2-HVR-H3-R94N | ANVRYGVGVPRYFDP | 466 |
| mAb2-HVR-H3-R94Q | AQVRYGVGVPRYFDP | 467 |
| mAb2-HVR-H3-R94T | ATVRYGVGVPRYFDP | 468 |
| mAb2-HVR-H3-V95A | ARARYGVGVPRYFDP | 469 |
| mAb2-HVR-H3-V95F | ARFRYGVGVPRYFDP | 470 |
| mAb2-HVR-H3-V95I | ARIRYGVGVPRYFDP | 471 |
| mAb2-HVR-H3-V95K | ARKRYGVGVPRYFDP | 472 |
| mAb2-HVR-H3-V95L | ARLRYGVGVPRYFDP | 473 |
| mAb2-HVR-H3-V95M | ARMRYGVGVPRYFDP | 474 |
| mAb2-HVR-H3-V95Q | ARQRYGVGVPRYFDP | 475 |
| mAb2-HVR-H3-V95S | ARSRYGVGVPRYFDP | 476 |
| mAb2-HVR-H3-R96A | ARVAYGVGVPRYFDP | 477 |
| mAb2-HVR-H3-R96I | ARVIYGVGVPRYFDP | 478 |
| mAb2-HVR-H3-R96K | ARVKYGVGVPRYFDP | 479 |
| mAb2-HVR-H3-R96L | ARVLYGVGVPRYFDP | 480 |
| mAb2-HVR-H3-R96M | ARVMYGVGVPRYFDP | 481 |
| mAb2-HVR-H3-R96P | ARVPYGVGVPRYFDP | 482 |
| mAb2-HVR-H3-R96Q | ARVQYGVGVPRYFDP | 483 |
| mAb2-HVR-H3-R96S | ARVSYGVGVPRYFDP | 484 |
| mAb2-HVR-H3-R96T | ARVTYGVGVPRYFDP | 485 |
| mAb2-HVR-H3-R96V | ARVVYGVGVPRYFDP | 486 |
| mAb2-HVR-H3-Y97H | ARVRHGVGVPRYFDP | 487 |
| mAb2-HVR-H3-Y97I | ARVRIGVGVPRYFDP | 488 |
| mAb2-HVR-H3-Y97L | ARVRLGVGVPRYFDP | 489 |
| mAb2-HVR-H3-Y97V | ARVRVGVGVPRYFDP | 490 |
| mAb2-HVR-H3-V99A | ARVRYGAGVPRYFDP | 491 |
| mAb2-HVR-H3-V99F | ARVRYGFGVPRYFDP | 492 |
| mAb2-HVR-H3-V99G | ARVRYGGGVPRYFDP | 493 |
| mAb2-HVR-H3-V99K | ARVRYGKGVPRYFDP | 494 |
| mAb2-HVR-H3-V99M | ARVRYGMGVPRYFDP | 495 |
| mAb2-HVR-H3-V99N | ARVRYGNGVPRYFDP | 496 |
| mAb2-HVR-H3-V99Q | ARVRYGQGVPRYFDP | 497 |

TABLE 2-continued

Anti-IL-36 antibody sequences

| Description | Sequence | SEQ ID NO: |
|---|---|---|
| mAb2-HVR-H3-V99R | ARVRYGRGVPRYFDP | 498 |
| mAb2-HVR-H3-V99S | ARVRYGSGVPRYFDP | 499 |
| mAb2-HVR-H3-V99T | ARVRYGTGVPRYFDP | 500 |
| mAb2-HVR-H3-V99W | ARVRYGWGVPRYFDP | 501 |
| mAb2-HVR-H3-V99Y | ARVRYGYGVPRYFDP | 502 |
| mAb2-HVR-H3-G100N | ARVRYGVNVPRYFDP | 503 |
| mAb2-HVR-H3-G100R | ARVRYGVRVPRYFDP | 504 |
| mAb2-HVR-H3-G100S | ARVRYGVSVPRYFDP | 505 |
| mAb2-HVR-H3-G100T | ARVRYGVTVPRYFDP | 506 |
| mAb2-HVR-H3-Y100dF | ARVRYGVGVPRFFDP | 507 |
| mAb2-HVR-H3-Y100dH | ARVRYGVGVPRHFDP | 508 |
| mAb2-HVR-H3-Y100dI | ARVRYGVGVPRIFDP | 509 |
| mAb2-HVR-H3-Y100dL | ARVRYGVGVPRLFDP | 510 |
| mAb2-HVR-H3-Y100dM | ARVRYGVGVPRMFDP | 511 |
| mAb2-HVR-H3-Y100dQ | ARVRYGVGVPRQFDP | 512 |
| mAb2-HVR-H3-Y100dR | ARVRYGVGVPRRFDP | 513 |
| mAb6_2.7-HC (SEQ ID NO: 191) + c-term K | ELQLQESGPGLVKPSETLSLTCTVSGGSITASNTYWGWIRQPPGKGLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LMISRTPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPGK | 581 |
| mAb6_2.7-HC (SEQ ID NO: 191) + YTE | ELQLQESGPGLVKPSETLSLTCTVSGGSITASNTYWGWIRQPPGKGLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LYITREPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPG | 582 |
| mAb6_2.7-HC (SEQ ID NO: 191) + YTE + c-term K | ELQLQESGPGLVKPSETLSLTCTVSGGSITASNTYWGWIRQPPGKGLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LYITREPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPGK | 583 |
| mAb6_2.7-HC (knob) (SEQ ID NO: 192) + c-term K | ELQLQESGPGLVKPSETLSLTCTVSGGSITASNTYWGWIRQPPGKGLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LMISRTPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPGK | 584 |

TABLE 2-continued

Anti-IL-36 antibody sequences

| Description | Sequence | SEQ ID NO: |
|---|---|---|
| mAb6_2.7-HC (knob) (SEQ ID NO: 192) + YTE | ELQLQESGPGLVKPSETLSLTCTVSGGSITASNTYWGWIRQPPGKLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LYITREPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPG | 585 |
| mAb6_2.7-HC (knob) (SEQ ID NO: 192) + YTE + c-term K | ELQLQESGPGLVKPSETLSLTCTVSGGSITASNTYWGWIRQPPGKLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LYITREPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPGK | 586 |
| mAb6_2.7-HC (hole) (SEQ ID NO: 193) + c-term K | ELQLQESGPGLVKPSETLSLTCTVSGGSITASNTYWGWIRQPPGKLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LMISRTPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPGK | 587 |
| mAb6_2.7-HC (hole) (SEQ ID NO: 193) + YTE | ELQLQESGPGLVKPSETLSLTCTVSGGSITASNTYWGWIRQPPGKLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LYITREPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPG | 588 |
| mAb6_2.7-HC (hole) (SEQ ID NO: 193) + YTE + c-term K | ELQLQESGPGLVKPSETLSLTCTVSGGSITASNTYWGWIRQPPGKLEWIG SIDYTGSTYYNPSLKSRVTISVDTSKNQFSLKLSSVTAADTAVYYCATGKY YETYLGFDVWGQGTLVTVSSASTKGPSVFPLAPSSKSTSGGTAALGCLVKD YFPEPVTVSWNSGALTSGVHTFPAVLQSSGLYSLSSVVTVPSSSLGTQTYI CNVNHKPSNTKVDKKVEPKSCDKTHTCPPCPAPELLGGPSVFLFPPKPKDT LYITREPEVTCVVVDVSHEDPEVKFNWYVDGVEVHNAKTKPREEQYGSTYR VVSVLTVLHQDWLNGKEYKCKVSNKALPAPIEKTISKAKGQPREPQVYTLP PSRDELTKNQVSLTCLVKGFYPSDIAVEWESNGQPENNYKTTPPVLDSDGS FFLYSKLTVDKSRWQQGNVFSCSVMHEALHNHYTQKSLSLSPGK | 589 |
| mAb2-HC (SEQ ID NO: 203) + term K | ELQLQESGPGLVKPSETLSLTCTVSGGSISTSSYYWGWIRQPPGKLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 617 |
| mAb2-HC (SEQ ID NO: 203) + YTE | ELQLQESGPGLVKPSETLSLTCTVSGGSISTSSYYWGWIRQPPGKLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 618 |

TABLE 2-continued

Anti-IL-36 antibody sequences

| Description | Sequence | SEQ ID NO: |
|---|---|---|
| mAb2-HC (SEQ ID NO: 203) + YTE + c-term K | ELQLQESGPGLVKPSETLSLTCTVSGGSISTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 619 |
| mAb2-HC (knob) (SEQ ID NO: 204) + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 620 |
| mAb2-HC (knob) (SEQ ID NO: 204) + YTE | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 621 |
| mAb2-HC (knob) (SEQ ID NO: 204) + YTE + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 622 |
| mAb2-HC (hole) (SEQ ID NO: 205) + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 623 |
| mAb2-HC (hole) (SEQ ID NO: 205) + YTE | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 624 |
| mAb2-HC (hole) (SEQ ID NO: 205) + YTE + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 625 |

TABLE 2-continued

Anti-IL-36 antibody sequences

| Description | Sequence | SEQ ID NO: |
|---|---|---|
| mAb2.10-HC (SEQ ID NO: 233) + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 707 |
| mAb2.10-HC (SEQ ID NO: 233) + YTE | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 708 |
| mAb2.10-HC (SEQ ID NO: 233) + YTE + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 709 |
| mAb2.10-HC (knob) (SEQ ID NO: 234) + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 710 |
| mAb2.10-HC (knob) (SEQ ID NO: 234) + YTE | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 711 |
| mAb2.10-HC (knob) (SEQ ID NO: 234) + YTE + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 712 |
| mAb2.10-HC (hole) (SEQ ID NO: 235) + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 713 |

TABLE 2-continued

Anti-IL-36 antibody sequences

| Description | Sequence | SEQ ID NO: |
|---|---|---|
| mAb2.10-HC (hole) (SEQ ID NO: 235) + YTE | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPG | 714 |
| mAb2.10-HC (hole) (SEQ ID NO: 235) + YTE + c-term K | ELQLQESGPGLVKPSETLSLTCTVSGGSTSTSSYYWGWIRQPPGKGLEWIG SIYYTGNTYYNPSLKSRVTISVDTSKNQFSLKLSSVTAADTAVYYCARVRY GVGVPRYFDPWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TYITRETPEVTCVVVDVSHEDPEVKFNWYVDGVEVHNAKTKPREEQYGSTY RVVSVLTVLHQDWLNGKEYKCKVSNKALPAPIEKTISKAKGQPREPQVYTL PPSRDELTKNQVSLTCLVKGFYPSDIAVEWESNGQPENNYKTTPPVLDSDG SFFLYSKLTVDKSRWQQGNVFSCSVMHEALHNHYTQKSLSLSPGK | 715 |

1. Binding Affinity and Cell-Signaling Inhibition of Anti-IL-36 Antibodies

In some embodiments, the anti-IL-36 antibodies provided herein have an equilibrium dissociation constant ($K_D$) for binding the human cytokines, hu-IL-36α, hu-IL-36β, and/or hu-IL-36γ of <100 nM, <10 nM, <1 nM, <0.1 nM, <0.01 nM, or <0.001 nM (e.g., $10^{-8}$ M or less, from $10^{-8}$ M to $10^{-13}$ M, e.g., from $10^{-9}$ M to $10^{-13}$ M). More specifically, in some embodiments, the anti-IL-36 antibodies of the present disclosure bind to hu-IL-36α, hu-IL-36β, and/or hu-IL-36γ with a binding affinity of $1\times10^{-13}$ M or less, $1\times10^{-9}$ M or less, $1\times10^{-10}$ M or less, or $1\times10^{-11}$ M or less. In some embodiments, the binding affinity is measured as the equilibrium dissociation constant ($K_D$) for binding to the hu-IL-36α, hu-IL-36β, or hu-IL-36γ polypeptide constructs of SEQ ID NO: 1, 2, and 3, respectively.

Generally, binding affinity of a ligand to its receptor can be determined using any of a variety of assays and expressed in terms of a variety of quantitative values. Specific IL-36 binding assays useful in determining affinity of the antibodies are disclosed in the Examples herein. Additionally, antigen binding assays are known in the art and can be used herein including without limitation any direct or competitive binding assays using techniques such as western blots, radioimmunoassays, enzyme-linked immunoabsorbent assay (ELISA), "sandwich" immunoassays, surface plasmon resonance based assay (such as the BIAcore assay as described in WO2005/012359), immunoprecipitation assays, fluorescent immunoassays, and protein A immunoassays.

In some embodiments, the binding affinity is expressed as $K_D$ values and reflects intrinsic binding affinity (e.g., with minimized avidity effects). The anti-IL-36 antibodies of the present disclosure exhibit strong binding affinities for the hu-IL-36α, hu-IL-36β, and/or hu-IL-36γ polypeptide constructs of SEQ ID NO: 1, 2, and 3, respectively, for example, exhibiting $K_D$ values of between 10 nM and 1 pM.

In some embodiments, the anti-IL-36 antibodies provided herein decrease, inhibit, and/or fully-block intracellular signaling by IL-36-mediated pathways, specifically, the signaling pathways that are stimulated by binding to IL-36R of IL-36α, IL-36β, and/or IL-36γ. The ability of the antibodies to inhibit these IL-36-mediated signaling pathways can be assayed in vitro using known cell-based blocking assays including, the HEK-BLUE™ reporter cell assays and the primary cell-based blocking assays described in the Examples of the present disclosure. In some instances, IL-8 expression may be employed as an indicator of signaling through an IL-36-mediated pathway, including e.g., where reduced IL-8 levels indicate blocking of one or more IL-36-mediated pathways.

In some embodiments, the ability of the antibody to decrease, inhibit, and/or fully-block IL-36 stimulated signaling is determined as $IC_{50}$ of the antibody using a reporter cell-based blocking assay with the agonist cytokine(s) IL-36α, IL-36β, and/or IL-36γ at a concentration of about $EC_{50}$. The agonist $EC_{50}$ often can only be estimated prior to the assay and is determined after the assay is completed using nonlinear regression analysis of the data. In such assays, a value of about $EC_{50}$ typically will be in the range of from $EC_{40-45}$ to $EC_{50}$.

Accordingly, in some embodiments, the IL-36 antibodies of the present disclosure are characterized by one or more of the following functional properties based on the ability to decrease, inhibit, and/or fully-block intracellular signaling by IL-36-mediated pathways.

In some embodiments of the anti-IL-36 antibody, the antibody decreases a signal stimulated by (or initiated by) any of IL-36α, IL-36β, or IL-36γ, by at least 90%, at least 95%, at least 99%, or 100%. In some embodiments, the decrease in signal can be measured using a cell-based assay. One of ordinary skill can select any of the known cell-based assays known for use in determining inhibition of cell-signaling of an IL-36 stimulated pathway. Generally, the anti-IL-36 antibodies of the present disclosure decrease the IL-36-mediated intracellular signal initiated by binding of an agonist cytokine IL-36α, IL-36β, or IL-36γ at a concentration of about $EC_{50}$ (e.g., $EC_{40}$ to $EC_{60}$) with an $IC_{50}$ value for the antibody of 10 nM or less, 5 nM or less, or 1 nM.

In some embodiments the anti-IL-36 antibody decreases an IL-36 stimulated signal by at least 95%, or at least 99%; optionally, wherein the IL-36 stimulated signal is stimulated by an agonist cytokine selected from IL-36α, IL-36β, and IL-36γ; optionally, wherein at an agonist cytokine concentration of about $EC_{50}$ the antibody has an $IC_{50}$ of 10 nM or less, 5 nM or less, or 1 nM or less.

In some embodiments the anti-IL-36 antibody decreases an intracellular signal initiated by one or more of IL-36α, IL-36β, and IL-36γ agonist binding to its cognate receptor by at least 90%, at least 95%, at least 99%, or 100%.

In some embodiments the anti-IL-36 antibody inhibits IL-36α, IL-36β, and/or IL-36γ stimulated release of IL-8 from primary human keratinocyte cells and/or HaCAT cells; optionally, wherein at an IL-36α, IL-36β, and/or IL-36γ concentration of about $EC_{50}$ the antibody has an $IC_{50}$ of 10 nM or less, 5 nM or less, or 1 nM or less.

2. Antibody Fragments

In some embodiments, the anti-IL-36 antibody of the present disclosure can be an antibody fragment. Antibody fragments useful with the binding determinants the present disclosure include, but are not limited to, Fab, Fab', Fab'-SH, F(ab')$_2$, Fv, monovalent, one-armed (or single-armed) antibodies, scFv fragments, and other fragments described herein and known in the art. For a review of various antibody fragments, see e.g., Hudson et al. Nat. Med. 9: 129-134 (2003). For a review of scFv fragments, see, e.g., Pluckthun, in The Pharmacology of Monoclonal Antibodies, vol. 113, Rosenburg and Moore eds., (Springer-Verlag, New York), pp. 269-315 (1994); see also WO93/16185; and U.S. Pat. Nos. 5,571,894 and 5,587,458. For a description of Fab and F(ab')$_2$ fragments comprising salvage receptor binding epitope residues and having increased in vivo half-life, see U.S. Pat. No. 5,869,046. Other monovalent antibody forms are described in, e.g., WO2007/048037, WO2008/145137, WO2008/145138, and WO2007/059782. Monovalent, single-armed antibodies are described, e.g., in WO2005/063816. Diabodies are antibody fragments with two antigen-binding sites that may be bivalent or bispecific (see e.g., EP0404097; WO93/01161; Hudson et al., Nat. Med. 9:129-134 (2003); and Hollinger et al., Proc. Natl. Acad. Sci. USA 90: 6444-6448 (1993)).

In some embodiments, the antibody fragments are single-domain antibodies which comprise all or a portion of the heavy chain variable domain or all or a portion of the light chain variable domain of an antibody. In some embodiments, a single-domain antibody is a human single-domain antibody (Domantis, Inc., Waltham, MA; see, e.g., U.S. Pat. No. 6,248,516).

Antibody fragments can be made by various techniques, including but not limited to proteolytic digestion of an intact antibody as well as production by recombinant host cells (e.g., *E. coli* or phage), as described herein.

It is contemplated that any of the anti-IL-36 antibodies of the present disclosure can be prepared as antibody fragments using the methods and techniques known in the art and/or described herein. For example, the preparation and analysis of Fab versions of various anti-IL-36 antibodies of the present disclosure are described in the Examples below.

3. Chimeric and Humanized Antibodies

In some embodiments, the anti-IL-36 antibody of the present disclosure can be a chimeric antibody. (See e.g., chimeric antibodies as described in U.S. Pat. No. 4,816,567; and Morrison et al., Proc. Natl. Acad. Sci. USA, 81:6851-6855 (1984)). In one embodiment, a chimeric antibody comprises a non-human variable region (e.g., a variable region derived from a mouse, rat, hamster, rabbit, or non-human primate, such as a monkey) and a human constant region. In some embodiments, a chimeric antibody is a "class switched" antibody in which the class or subclass has been changed from that of the parent antibody. It is contemplated that chimeric antibodies can include antigen-binding fragments thereof.

In some embodiments, the anti-IL-36 antibody of the present disclosure is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the CDR residues are derived) to restore or improve antibody specificity or affinity.

Humanized antibodies and methods of making them are reviewed, e.g., in Almagro and Fransson, Front. Biosci. 13: 1619-1633 (2008), and are further described, e.g., in Riechmann et al., Nature 332:323-329 (1988); Queen et al., Proc. Nat 1 Acad. Sci. USA 86: 10029-10033 (1989); U.S. Pat. Nos. 5,821,337, 7,527,791, 6,982,321, and 7,087,409; Kashmiri et al, Methods 3625-34 (2005) (describing SDR (a-HVR) grafting); Padlan, Mol. Immunol. 28:489-498 (1991) (describing "resurfacing"); Dall'Acqua et al., Methods 36:43-60 (2005) (describing "FR shuffling"); and Osbourn et al., Methods 36:61-68 (2005) and Klimka et al., Br. J. Cancer, 83 252-260 (2000) (describing the "guided selection" approach to FR shuffling).

Human framework regions that are useful for humanization include but are not limited to: framework regions selected using the "best-fit" method (see, e.g., Sims et al. J. Immunol. 151:2296 (1993)); framework regions derived from the consensus sequence of human antibodies of a particular subgroup of light or heavy chain variable regions (see, e.g., Carter et al. Proc. Natl. Acad. Sci. USA, 89:4285 (1992); and Presta et al. J. Immunol, 151:2623 (1993)); human mature (somatically mutated) framework regions or human germline framework regions (see, e.g., Almagro and Fransson, Front. Biosci. 13: 1619-1633 (2008)); and framework regions derived from screening FR libraries (see, e.g., Baca et al., J. Biol. Chem. 272: 10678-10684 (1997) and Rosok et al., J. Biol. Chem. 271:2261 1-22618 (1996)).

It is contemplated that any of the anti-IL-36 antibodies of the present disclosure can be prepared as humanized antibodies using the methods and techniques known in the art and/or described herein.

4. Human Antibodies

In some embodiments, the anti-IL-36 antibody of the present disclosure can be a human antibody. Human antibodies can be produced using various techniques known in the art. Human antibodies are described generally in van Dijk and van de Winkel, Curr. Opin. Pharmacol. 5:368-74 (2001) and Lonberg, Curr. Opin. Immunol. 20:450-459 (2008). Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, Nat. Biotech. 23:1117-1125 (2005). See also, e.g., XENOMOUSE™ technology in U.S. Pat. Nos. 6,075,181 and 6,150,584; HUMAB® technology in U.S. Pat. No. 5,770,429; K-M MOUSE® technology in U.S. Pat. No. 7,041,870; and VELOCIMOUSE® technology in U.S. Pat. Appl. Pub. No. US 2007/0061900). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. See, e.g., Kozbor J. Immunol, 133: 3001 (1984); Brodeur et al., Monoclonal Antibody Production Techniques and Applications, pp. 51-63 (Marcel Dekker, Inc., New York, 1987); and Boemer et al., J. Immunol., 147: 86 (1991). Human antibodies generated via human B-cell hybridoma technology are also described in Li et al., Proc. Natl. Acad. Sci. USA, 103:3557-3562 (2006). Additional methods describing production of monoclonal human IgM antibodies from hybridoma cell lines include those described in e.g., U.S. Pat. No. 7,189,826. Human hybridoma technology (i.e., the trioma technique) is described in e.g., Vollmers et al., Histology and Histopathology, 20(3):927-937 (2005) and Vollmers et al., and Methods and Findings in Experimental and Clinical Pharmacology, 27(3): 185-91 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

It is contemplated that any of the anti-IL-36 antibodies of the present disclosure can be prepared as human antibodies using the methods and techniques known in the art and/or described herein, including in the Examples.

5. Library-Derived Antibodies

In some embodiments, the anti-IL-36 antibody of the present disclosure may be isolated by screening combinatorial libraries for antibodies with the desired activity or activities. For example, a method may be used to generate a phage display library and the library may be screened for antibodies possessing the desired binding characteristics. The use of phage display for preparation of affinity matured variants of the humanized version of the anti-IL-36 antibody of the present disclosure are described in the Examples disclosed herein. Other methods for producing such library-derived antibodies can be found in e.g., Hoogenboom et al., Methods in Molecular Biology 178: 1-37 (O'Brien et al., ed., Human Press, Totowa, NJ, 2001); McCafferty et al., Nature 348:552-554; Clackson et al., Nature 352: 624-628 (1991); Marks et al., J. Mol. Biol. 222: 581-597 (1992); Marks and Bradbury, m Methods in Molecular Biology 248:161-175 (Lo, ed., Human Press, Totowa, NJ, 2003); Sidhu et al., J. Mol. Biol. 338(2): 299-310 (2004); Lee et al., J. Mol. Biol. 340(5): 1073-1093 (2004); Fellouse, Proc. Natl. Acad. Sci. USA 101(34): 12467-12472 (2004); and Lee et al., J. Immunol. Methods 284(1-2): 119-132(2004).

It is contemplated that combinatorial library screening can be used to generate variants of the anti-IL-36 antibodies of the present disclosure using and/or adapting methods and techniques known in the art with those described herein. For example, the use of phage display library generation and screening to prepare a wide-range of affinity matured variants of the anti-IL-36 antibodies of the present disclosure is described in the Examples.

6. Multispecific Antibodies

In some embodiments, the anti-IL-36 antibody of the present disclosure is a multispecific antibody, e.g., a trispecific or bispecific antibody. In some embodiments, the multispecific antibody is a monoclonal antibody having at least two different binding sites, each with a binding specificity for a different antigen, at least one of which specifically binds IL-36. Generally, it is contemplated that the binding specificities of any of the anti-IL-36 antibodies disclosed herein can be incorporated into a multispecific antibody useful for treating an IL-36 mediated disease. For example, in some embodiments, at least one of binding site of multispecific antibody specifically binds IL-36 (e.g., IL-36α, IL-36β, and/or IL-36γ) and another binding site of the multispecific antibody binds to a different antigen related to treatment of an IL-36 mediated disease.

In some embodiments, as described elsewhere herein, a multispecific antibody is contemplated that binds to each of human IL-36α, IL-36β, and IL-36γ with a high binding affinity (e.g., 3 nM or less). Such binding affinities can be measured as the equilibrium dissociation constant ($K_D$) to a hu-IL-36α of SEQ ID NO:1, a hu-IL-36β of SEQ ID NO:2, and a hu-IL-36γ of SEQ ID NO:3. It is further contemplated, that in some embodiments, the multispecific antibody can comprise a specificity for IL-36α and/or IL-36γ in one arm, and a specificity for IL-36β in the other arm.

Techniques for making multispecific antibodies include, but are not limited to, recombinant co-expression of two immunoglobulin heavy chain-light chain pairs having different specificities (see e.g., Milstein and Cuello, Nature 305: 537 (1983), WO 93/08829, and Traunecker et al., EMBO J. 10: 3655 (1991)). "Knob-in-hole" engineering can also be used (see, e.g., U.S. Pat. No. 5,731,168).

Multispecific antibodies can also be made by engineering "electrostatic steering" effects that favor formation of Fc-heterodimeric antibody molecules rather than homodimers (WO 2009/089004A1); cross-linking two or more antibodies or fragments (see, e.g., U.S. Pat. No. 4,676,980, and Brennan et al., Science, 229: 81 (1985)); using leucine zippers to produce bispecific antibodies (see, e.g., Kostelny et al., J. Immunol, 148(5): 1547-1553 (1992)); using "diabody" technology for making bispecific antibody fragments (see, e.g., Hollinger et al., Proc. Natl. Acad. Sci. USA, 90:6444-6448 (1993)); using single-chain Fv (scFv) dimers (see, e.g. Gruber et al., J. Immunol, 152:5368 (1994)); or tri-specific antibodies (see e.g., Tutt et al., J. Immunol. 147: 60 (1991).

It is contemplated that any of the anti-IL-36 antibodies of the present disclosure can be prepared as multispecific antibodies using the methods and techniques known in the art and/or described herein.

In some embodiments of the present disclosure, a multi-specific IL-36 antibody is contemplated that comprises separate binding specificities for one or more of the distinct IL-36 cytokines, IL-36α, IL-36β, and IL-36γ. For example, the multispecific antibody can bind to IL-36α, IL-36β, and IL-36γ with an affinity of 3 nM or less, and/or decrease an intracellular signal stimulated by IL-36α, IL-36β, and IL-36γ by at least 90%, and/or has an $IC_{50}$ of 10 nM or less at an IL-36α, IL-36β, and/or IL-36γ concentration of about $EC_{50}$. As described elsewhere herein, human IL-36 antibodies were isolated having high-affinity for IL-36α and IL-36γ, but lower affinity for IL-36β, and others were isolated having high-affinity for IL-36β, but lower affinity for IL-36α and IL-36γ. These specificities for these different human IL-36 cytokines were affinity matured and combined in a single multispecific IL-36 antibody. Accordingly, in some embodiments, the present disclosure provides a multispecific anti-IL-36 antibody with a target specificity and high affinity (e.g., 1 nM or less) for IL-36α/IL-36γ in one arm, and a target specificity and high affinity (e.g., 1 nM or less) for IL-36β in the other arm. The preparation and use of such a multispecific anti-IL-36 antibody is detailed in the Examples.

7. Antibody Variants

In some embodiments, variants of the anti-IL-36 antibody of the present disclosure are also contemplated. For example, antibodies with improved binding affinity and/or other biological properties of the antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristic of IL-36 antigen binding. It is contemplated that a wide-range of variants of the anti-IL-36 antibodies of the present disclosure can be prepared using the methods and techniques known in the art and/or described herein, including but not limited to: (i) amino acid substitution, insertion and/or deletion variants; (ii) glycosylation variants; (iii) Fc region variants; (iv) cysteine engineered variants; and (v) derivatized variants.

The Examples, Table 2, and the Sequence Listing of the present disclosure provide a large number of exemplary variants of two specific anti-IL-36 antibodies, "mAb2," and "mAb6_2." The exemplified variants comprise one or more of the following: a range of single, double, triple amino acid substitutions in HVR-H1, HVR-H2, and HVR-H3 that increase specific affinity for IL-36α/γ, or IL-36β, and/or cell-based blocking activities related to IL-36 mediated signaling; an Fc region variant that confers in effectoriess function (e.g., N297G); and heavy chain substitutions resulting in "knob" and "hole" structures that allow for multispecific antibody formation. For example, the heavy chain antibody sequences disclosed in Table 2 can further include a carboxy-terminal lysine (i.e., "C-terminal Lys" or "C-terminal K"), YTE mutations at positions 252, 254, and 256 (i.e., M252Y/S254T/T256E), or both a C-terminal K and YTE mutations. Such variants of the heavy chain sequences of SEQ ID NOs: 170-241, 243-245, 248-250 are provided in Table 2 (and the accompanying Sequence Listing) as SEQ ID NO: 518-751.

A. Substitution, Insertion, and Deletion Variants

In some embodiments, anti-IL-36 antibody variants having one or more amino acid substitutions in addition to those described herein are provided. Sites for mutagenesis can include the HVRs and FRs. Typical "conservative" amino acid substitutions and/or substitutions based on common side-chain class or properties are well-known in the art and can be used in the embodiments of the present disclosure. The present disclosure also contemplates variants based on non-conservative amino acid substitutions in which a member of one of amino acid side chain class is exchanged for an amino acid from another class.

Amino acid side chains are typically grouped according to the following classes or common properties: (1) hydrophobic: Met, Ala, Val, Leu, Ile, Norleucine; (2) neutral hydrophilic: Cys, Ser, Thr, Asn, Gln; (3) acidic: Asp, Glu; (4) basic: His, Lys, Arg; (5) chain orientation influencing: Gly, Pro; and (6) aromatic: Trp, Tyr, Phe.

Techniques are well-known in the art for amino acid substitution into an antibody and subsequent screening for desired function, e.g., retained/improved antigen binding, decreased immunogenicity, or improved ADCC or CDC.

Amino acid substitution variants can include substituting one or more hypervariable region residues of a parent antibody (e.g., a humanized or human antibody). Generally, the resulting variant(s) selected for further study will have modifications in certain biological properties (e.g., increased affinity, reduced immunogenicity) relative to the parent antibody and/or will have substantially retained certain biological properties of the parent antibody. An exemplary substitutional variant is an affinity matured antibody, which may be conveniently generated, e.g., using phage display-based affinity maturation techniques such as those described in the Examples herein. Briefly, one or more HVR residues are mutated and the variant antibodies displayed on phage and screened for a particular biological activity (e.g., binding affinity).

A useful method for identifying residues or regions of an antibody that may be targeted for mutagenesis is "alanine scanning mutagenesis" (see e.g., Cunningham and Wells (1989) Science, 244:1081-1085). In this method, a residue or group of target residues (e.g., charged residues such as Arg, Asp, His, Lys, and Glu) are identified and replaced by a neutral or negatively charged amino acid (e.g., Ala or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody complex to identify contact points between the antibody and antigen can be determined. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intra-sequence insertions of single or multiple amino acid residues. Examples of terminal insertions include an antibody with an N-terminal methionyl residue. Other insertional variants of the antibody molecule include the fusion to the N- or C-terminus of the antibody to an enzyme or a polypeptide which increases the serum half-life of the antibody.

Substitutions can be made in HVRs to improve antibody affinity. Such alterations may be made in "hotspots," i.e., residues encoded by codons that undergo mutation at high frequency during the somatic maturation process (see, e.g., Chowdhury, Methods Mol. Biol. 207: 179-196 (2008)) with the resulting variant $V_H$ or $V_L$ being tested for binding affinity. In one embodiment, affinity maturation can be carried out by constructing and re-selecting from secondary libraries (see e.g., in Hoogenboom et al., Methods in Molecular Biology 178:1-37 (O'Brien et al., ed., Human Press, Totowa, NJ, (2001).) Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. CDR-H3 and CDR-L3 in particular are often targeted.

In some embodiments, substitutions, insertions, or deletions may occur within one or more HVRs so long as such alterations do not substantially reduce the ability of the antibody to bind antigen. For example, conservative alterations (e.g., conservative substitutions as provided herein)

that do not substantially reduce binding affinity may be made in HVRs. Such alterations may be outside of HVR "hotspots." In some embodiments of the variant $V_H$ and $V_L$ sequences provided above, each HVR either is unaltered, or contains no more than one, two or three amino acid substitutions.

B. Glycosylation Variants

In some embodiments, the anti-IL-36 antibody of the present disclosure is altered to increase or decrease the extent to which the antibody is glycosylated. Addition or deletion of glycosylation sites to an antibody can be carried out by altering the amino acid sequence such that one or more glycosylation sites is created or removed.

In embodiments where the antibody comprises an Fc region, the carbohydrate attached to the Fc region can be altered. Typically, native antibodies produced by mammalian cells comprise a branched, biantennary oligosaccharide attached by an N-linkage to Asn297 of the CH2 domain of the Fc region (see, e.g., Wright et al. TIBTECH 15:26-32 (1997)). The oligosaccharide may include various carbohydrates, such as mannose, N-acetyl glucosamine (GlcNAc), galactose, and sialic acid, as well as, a fucose attached to a GlcNAc in the "stem" of the bi-antennary oligosaccharide structure. In some embodiments, the modifications of the oligosaccharide of an Fc region of an antibody can create a variant with certain improved properties.

In some embodiments, the anti-IL-36 antibody of the present disclosure can be a variant of a parent antibody, wherein the variant comprises a carbohydrate structure that lacks fucose attached (directly or indirectly) to an Fc region. For example, the amount of fucose in such antibody may be from about 1% to about 80%, from about 1% to about 65%, from about 5% to about 65%, or from about 20% to about 40%. The amount of fucose can be determined by calculating the average amount of fucose within the sugar chain at Asn297, relative to the sum of all glyco-structures attached to Asn 297 (e.g., complex, hybrid and high mannose structures) as measured by MALDI-TOF mass spectrometry (see e.g., WO 2008/077546). Asn297 refers to the asparagine residue located at about position 297 in the Fc region (Eu numbering of Fc region residues); however, Asn297 may also be located about ±3 amino acids upstream or downstream of position 297, i.e., between positions 294 and 300, due to minor sequence variations in antibodies.

In some embodiments, the fucosylation variants can have improved ADCC function. See, e.g., US Patent Publication Nos. US 2003/0157108, or US 2004/0093621. Examples of "defucosylated" or "fucose-deficient" antibodies and associated methods for preparing them are disclosed in e.g., US2003/0157108; US2003/0115614; US2002/0164328; US2004/0093621; US2004/0132140; US2004/0110704; US2004/0110282; US2004/0109865; WO2000/61739; WO2001/29246; WO2003/085119; WO2003/084570; WO2005/035586; WO2005/035778; WO2005/053742; WO2002/031140; Okazaki et al. J. Mol. Biol. 336:1239-1249 (2004); Yamane-Ohnuki et al. Biotech. Bioeng. 87: 614 (2004).

Cell lines useful for producing defucosylated antibodies include Led 3 CHO cells deficient in protein fucosylation (see e.g., Ripka et al. Arch. Biochem. Biophys. 249:533-545 (1986); US2003/0157108, and WO2004/056312), and knockout cell lines, such as alpha-1,6-fucosyltransferase gene, FUT8, knockout CHO cells (see, e.g., Yamane-Ohnuki et al. Biotech. Bioeng. 87: 614 (2004); Kanda, Y. et al., Biotechnol. Bioeng., 94(4):680-688 (2006); and WO2003/085107).

C. Fc Region Variants

In some embodiments, an anti-IL-36 antibody of the present disclosure can comprise one or more amino acid modifications in the Fc region (i.e., an Fc region variant). The Fc region variant may comprise a human Fc region sequence (e.g., a human IgG1, IgG2, IgG3, or IgG4 Fc region) comprising an amino acid substitution at one or more amino acid residue positions. A wide range of Fc region variants known in the art that are useful with the anti-IL-36 antibodies of the present disclosure are described below.

In some embodiments, the anti-IL-36 antibody is an Fc region variant which has altered effector function. In some embodiments, the antibody with altered effector function possesses some (but not all of) the effector functions, decreased effector function, or none of the effector functions (e.g., effectorless) of the parent antibody. Effectorless Fc region variants are more desirable for certain applications where effector function (such as ADCC) is unnecessary or deleterious, and/or in vivo half-life of the antibody is important.

Fc region variant antibodies with reduced effector function, or which are effectoriess, can include an amino acid substitution at one or more of the following Fc region positions: 238, 265, 269, 270, 297, 327 and 329. (see, e.g., U.S. Pat. No. 6,737,056). Such Fc region variants can include amino acid substitutions at two or more of positions 265, 269, 270, 297 and 327. Such Fc region variants can also include substitutions of both residues 265 and 297 to alanine (see e.g., U.S. Pat. No. 7,332,581). As disclosed in the Examples and elsewhere herein, in some embodiments, the anti-IL-36 antibodies of the present disclosure are effectorless Fc region variants. In some embodiments, the effectorless Fc region variants of the anti-IL-36 antibodies comprise the amino acid substitution N297G.

Fc region variants having improved or diminished binding to FcRs are disclosed in e.g., U.S. Pat. No. 6,737,056; WO 2004/056312; and Shields et al., J. Biol. Chem. 9(2): 6591-6604 (2001). Fc region variants having improved ADCC can comprise one or more amino acid substitutions at e.g., positions 298, 333, and/or 334 of the Fc region (based on EU numbering). Fc region variants having altered (i.e., either improved or diminished) C1q binding and/or Complement Dependent Cytotoxicity (CDC), as described in e.g., U.S. Pat. No. 6,194,551, WO99/51642, and Idusogie et al., J. Immunol. 164: 4178-4184 (2000). Fc region variants with increased half-lives and improved binding to the neonatal Fc receptor (FcRn) are disclosed in e.g., US2005/0014934A1 (Hinton et al.). Such Fc region variants comprise amino acid substitutions at one or more of positions: 238, 256, 265, 272, 286, 303, 305, 307, 311, 312, 317, 340, 356, 360, 362, 376, 378, 380, 382, 413, 424, and 434. Other Fc region variants with increased half-lives include the set of YTE mutations at positions 252, 254, and 256 (i.e., M252Y/S254T/T256E) described in e.g., U.S. Pat. No. 7,658,921B2 (Dall'Acqua et al.). Other examples of Fc region variants can be found in e.g., U.S. Pat. Nos. 5,648,260 and 5,624,821; and WO94/29351.

Generally, in vitro and/or in vivo cytotoxicity assays can be carried out to confirm the reduction/depletion of CDC and/or ADCC activities in an Fc region variant. For example, Fc receptor (FcR) binding assays can be conducted to ensure that the antibody lacks FcγR binding (hence likely lacking ADCC activity) but retains FcRn binding ability. The primary cells for mediating ADCC, NK cells express FcγRIII only, whereas monocytes express FcγRI, FcγRII, and FcγRIII. Non-limiting examples of in vitro assays to assess ADCC activity of a molecule of interest is described in U.S. Pat. No. 5,500,362 (see, e.g. Hellstrom, et al., Proc. Nat'l Acad. Sci. USA 83:7059-7063 (1986)) and Hellstrom, et al., Proc. Nat'l Acad. Sci. USA 82: 1499-1502 (1985); 5,821,337 (see Bruggemann, M. et al., J. Exp. Med. 166: 1351-1361 (1987)). Alternatively, non-radioactive assay methods may be employed (see, for example, ACTI™ nonradioactive cytotoxicity assay for flow cytometry (CellTechnology, Inc. Mountain View, CA; and Cyto-Tox96® non-radioactive cytotoxicity assay (Promega, Madison, WI). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. Proc. Nat'l Acad. Sci. USA 95:652-656 (1998). Clq binding assays may also be carried out to confirm that the antibody is unable to bind Clq and hence lacks CDC activity. See, e.g., Clq and C3c binding ELISA in WO2006/029879 and WO2005/100402. To assess complement activation, a CDC assay may be performed (see, e.g., Gazzano-Santoro et al., J. Immunol. Methods 202: 163 (1996); Cragg, M. S. et al., Blood 101:1045-1052 (2003); and Cragg, M. S. and M. J. Glennie, SW 103:2738-2743 (2004)). FcRn binding and in vivo clearance/half-life determinations can be performed using methods known in the art (see, e.g., Petkova, et al., Intl. Immunol. 18(12): 1759-1769 (2006)).

It is contemplated that a wide-range of Fc region variants of the anti-IL-36 antibodies of the present disclosure can be prepared using the methods and techniques known in the art and/or described herein. For example, the Fc region variant prepared with the N297G amino acid substitution confers effectorless function on anti-IL-36 antibodies with retention of cell-based blocking activity as described in Examples 2, 3, and 8.

D. Cysteine Engineered Variants

In some embodiments, it is contemplated that the anti-IL-36 antibody described herein can be substituted at specific non-CDR positions with cysteine residues so as to create reactive thiol groups. Such engineered "thioMAbs" can be used to conjugate the antibody to e.g., drug moieties or linker-drug moieties and thereby create immunoconjugates, as described elsewhere herein. Cysteine engineered antibodies can be generated as described in e.g., U.S. Pat. No. 7,521,541. In some embodiments, any one or more of the following antibody residues can be substituted with cysteine: V205 (Kabat numbering) of the light chain; A118 (EU numbering) of the heavy chain; and S400 (EU numbering) of the heavy chain Fc region.

E. Derivatized Variants

In some embodiments, the anti-IL-36 antibody of the present disclosure may be further modified (i.e., derivatized) with non-proteinaceous moieties. Non-proteinaceous moieties suitable for derivatization of the antibody include, but are not limited to, water soluble polymers, such as: polyethylene glycol (PEG), copolymers of ethylene glycol and propylene glycol, carboxy-methylcellulose, dextran, polyvinyl alcohol, polyvinyl pyrrolidone, poly-1, 3-dioxolane, poly-1, 3, 6-trioxane, ethylene/maleic anhydride copolymer, poly-amino acid homo-polymers or random co-polymers, and dextran or poly(n-vinyl pyrrolidone)polyethylene glycol, propylene glycol homo-polymers, polypropylene oxide/ethylene oxide co-polymers, polyoxy-ethylated polyols (e.g., glycerol), polyvinyl alcohol, and mixtures thereof. In some embodiments, modification of the antibody can be carried out using methoxy-polyethylene glycol propionaldehyde. The polymers may be of any molecular weight and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody, e.g., whether the antibody derivative will be used in a therapy under defined conditions.

8. Immunoconjugates

In some embodiments, the anti-IL-36 antibody of the present disclosure can also be an immunoconjugate, wherein the immunoconjugate comprises an anti-IL-36 antibody conjugated to one or more cytotoxic agents. Suitable cytotoxic agents contemplated by the present disclosure include chemotherapeutic agents, drugs, growth inhibitory agents, toxins (e.g., protein toxins, enzymatically active toxins of bacterial, fungal, plant, or animal origin, or fragments thereof), or radioactive isotopes.

In some embodiments, the immunoconjugate is an antibody-drug conjugate (ADC) in which an anti-IL-36 antibody, as described herein, is conjugated to one or more drugs.

In some embodiments, an immunoconjugate of the present disclosure comprises an anti-IL-36 antibody as described herein conjugated to a drug or therapeutic agent for the treatment of an IL-36-mediated disease or condition.

In some embodiments, an anti-IL-36 antibody as described herein can be conjugated to an enzymatically active toxin or a fragment thereof, including but not limited to diphtheria A chain, non-binding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins, *Momordica charantia* inhibitor, curcin, crotin, *Sapaonaria officinalis* inhibitor, gelonin, mitogellin, restrictocin, phenomycin, enomycin, and the tricothecenes.

In some embodiments, an immunoconjugate of the present disclosure comprises an anti-IL-36 antibody as described herein conjugated to a radioactive isotope (i.e., a radioconjugate). A variety of radioactive isotopes are available for the production of such radioconjugates. Examples include $^{211}$At, $^{131}$I, $^{125}$I, $^{90}$Y, $^{186}$Re, $^{188}$Re, $^{153}$Sm, $^{212}$Bi, $^{32}$P, $^{212}$Pb, and radioactive isotopes of Lu. In some embodiments, the immunoconjugate may comprise a radioisotope for scintigraphic detection, or a spin label for NMR detection or MRI. Suitable radioisotopes or spin labels can include, as $^{123}$I, $^{131}$I, $^{111}$In, $^{13}$C, $^{19}$F, $^{15}$N, $^{17}$O, various isotopes of Gd, Mn, and Fe.

Immunoconjugates of an anti-IL-36 antibody and a cytotoxic agent, can be made using a variety of well-known bifunctional reagents and chemistries suitable for conjugating to proteins. Such reagents include but are not limited to: N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (e.g., dimethyl adipimidate HQ), active esters (e.g., disuccinimidyl suberate), aldehydes (e.g., glutaraldehyde), bis-azido compounds (e.g., bis-(p-azidobenzoyl)-hexanediamine), bis-diazonium derivatives (e.g., bis-(p-diazoniumbenzoyl)-ethylenediamine), diisocyanates (e.g., toluene-2,6-diisocyanate), and bis-active fluorine compounds (e.g., 1,5-difluoro-2,4-dinitrobenzene).

Reagents for preparing immunoconjugates of the present disclosure can also include commercially available "cross-linking" reagents such as: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) (see e.g., Pierce Biotechnology, Inc., Rockford, IL., U.S.A).

9. Synthetic Antibodies

In some embodiments, the anti-IL-36 antibody of the present disclosure can be a synthetic antibody comprising a set of CDRs from an anti-IL-36 immunoglobulin (e.g., CDR-L1, etc.) grafted onto a scaffold or framework other than an immunoglobulin scaffold or framework, such as an alternative protein scaffold, or an artificial polymer scaffold.

Exemplary alternative protein scaffolds contemplated for preparation of synthetic antibodies of the present disclosure can include, but are not limited to: fibronectin, neocarzinostatin CBM4-2, lipocalins, T-cell receptor, protein-A domain (protein Z), Im9, TPR proteins, zinc finger domains, pVIII, avian pancreatic polypeptide, GCN4, WW domain Src homology domain 3, PDZ domains, TEM-1 beta-lactamase, thioredoxin, staphylococcal nuclease, PHD-finger domains, CL-2, BPTI, APPI, HPSTI, ecotin, LACI-D1, LDTI, MTI-II, scorpion toxins, insect defensin-A peptide, EETI-II, Min-23, CBD, PBP, cytochrome b-562, Ldl receptor domains, gamma-crystallin, ubiquitin, transferrin, and/or C-type lectin-like domains.

Exemplary artificial polymer (non-protein) scaffolds useful for synthetic antibodies are described in e.g., Fiedler et al., (2014) "Non-Antibody Scaffolds as Alternative Therapeutic Agents," in Handbook of Therapeutic Antibodies (eds. S. Dübel and J. M. Reichert), Wiley-VCH Verlag GmbH & Co.; Gebauer et al., Curr. Opin. Chem. Biol., 13:245-255 (2009); Binz et al, Nat. Biotech., 23(10): 1257-1268 (2005).

IV. Recombinant Methods and Compositions

The anti-IL-36 antibody of the present disclosure can be produced using recombinant methods and materials well-known in the art of antibody production. In some embodiments, the present disclosure provides an isolated nucleic acid encoding an anti-IL-36 antibody. The nucleic acid can encode an amino acid sequence comprising the $V_L$ and/or an amino acid sequence comprising the $V_H$ of the antibody (e.g., the light and/or heavy chains of the antibody). In some embodiments, one or more vectors (e.g., expression vectors) comprising nucleic acid sequences encoding an anti-IL-36 antibody of the present disclosure are provided. In some embodiments, a host cell comprising nucleic acid sequences encoding an anti-IL-36 antibody of the present disclosure are provided. In one embodiment, the host cell has been transformed with a vector comprising a nucleic acid that encodes an amino acid sequence comprising the $V_L$ of the antibody and an amino acid sequence comprising the $V_H$ of the antibody. In another embodiment, the host cell has been transformed with a first vector comprising a nucleic acid that encodes an amino acid sequence comprising the $V_L$ of the antibody and a second vector comprising a nucleic acid that encodes an amino acid sequence comprising the $V_H$ of the antibody.

In some embodiments of the recombinant methods, the host cell used is a eukaryotic cell, such as a Chinese Hamster Ovary (CHO) cell, or a lymphoid cell (e.g., Y0, NS0, Sp20). In one embodiment, a method of making an anti-IL-36 antibody is provided, wherein the method comprises culturing a host cell comprising a nucleic acid encoding the antibody, as provided above, under conditions suitable for expression of the antibody, and optionally recovering the antibody from the host cell (or host cell culture medium).

Briefly, recombinant production of an anti-IL-36 antibody is carried out by isolating a nucleic acid encoding an antibody (e.g., as described herein) and inserting this nucleic acid into one or more vectors for further cloning and/or expression in a host cell. Such nucleic acids are readily isolated and sequenced using conventional procedures well-known in the art (e.g., by using oligonucleotide probes that are capable of binding specifically to genes encoding the heavy and light chains of the desired antibody). Suitable host cells and culturing methods for cloning or expressing the antibody-encoding vectors are well-known in the art and include prokaryotic or eukaryotic cells. Typically, after expression, the antibody may be isolated from cell paste in a soluble fraction and further purified. In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern (see e.g., Gemgross, Nat. Biotech. 22: 1409-1414 (2004), and Li et al., Nat. Biotech. 24:210-215 (2006)).

Suitable host cells for the expression of glycosylated anti-IL-36 antibodies of the present disclosure can also be derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells. Plant cell cultures can also be utilized as hosts (see, e.g., U.S. Pat. Nos. 5,959,177, 6,040,498, 6,420,548, and 7,125,978.

Examples of mammalian host cell lines useful for the production of the anti-IL-36 antibodies of the present disclosure include Chinese hamster ovary (CHO) cells, including DHFR-CHO cells (see e.g., Uriaub et al., Proc. Natl. Acad. Sci. USA 77:4216 (1980)); myeloma cell lines such as Y0, NS0 and Sp2/0; monkey kidney CVI line transformed by SV40 (COS-7); human embryonic kidney line (293 or 293 cells as described, e.g., in Graham et al., J. Gen Virol. 36:59 (1977)); baby hamster kidney cells (BHK); mouse Sertoli cells (TM4 cells as described, e.g., in Mather, Biol. Reprod. 23:243-251 (1980)); monkey kidney cells (CVI); African green monkey kidney cells (VERO-76); human cervical carcinoma cells (HELA); canine kidney cells (MDCK); buffalo rat liver cells (BRL 3A); human lung cells (W138); human liver cells (Hep G2); mouse mammary tumor (MMT 060562); TR1 cells (see e.g., in Mather et al., Annals N.Y. Acad. Sci. 383:44-68 (1982) and U.S. Pat. No. 6,235,498); Medical Research Council 5 (MRC 5) cells (such as e.g., those available from ATCC and also referred to as CCL-171); and Foreskin 4 (FS4) cells (see e.g., in Vilcek et al. Ann. N. Y. Acad. Sci. 284:703-710 (1977), Gardner & Vilcek. J. Gen. Virol. 44:161-168 (1979), and Pang et al. Proc. Natl. Acad. Sci. U.S.A. 77:5341-5345 (1980)). For a general review of useful mammalian host cell lines suitable for antibody production, see, e.g., Yazaki and Wu, Methods in Molecular Biology, Vol. 248 (B.K.C. Lo, ed., Humana Press, Totowa, NJ), pp. 255-268 (2003).

V. Pharmaceutical Compositions and Formulations of Anti-IL-36 Antibodies

The present disclosure also provides pharmaceutical compositions and pharmaceutical formulations comprising an anti-IL-36 antibody. In some embodiments, the present disclosure provides a pharmaceutical formulation comprising an anti-IL-36 antibody as described herein and a pharmaceutically acceptable carrier. In some embodiments, the anti-IL-36 antibody is the sole active agent of the pharmaceutical composition. Such pharmaceutical formulations can be prepared by mixing an anti-IL-36 antibody, having the desired degree of purity, with one or more pharmaceutically acceptable carriers. Typically, such antibody formulations can be prepared as an aqueous solution (see e.g., U.S. Pat. No. 6,171,586, and WO2006/044908) or as a lyophilized formulation (see e.g., U.S. Pat. No. 6,267,958).

It is also contemplated that the compositions and formulations comprising an anti-IL-36 antibody as disclosed herein may further contain other active ingredients (i.e., therapeutic agents) in addition to the anti-IL-36, useful for the particular indication being treated in the subject to whom the formulation is administered. Preferably, any additional therapeutic agent has activity complementary to that of the anti-IL-36 antibody activity and the activities do not adversely affect each other. Accordingly, in some embodiments, the disclosure provides a pharmaceutical composition comprising an anti-IL-36 antibody as disclosed herein, and a pharmaceutically acceptable carrier, and further comprises a therapeutic agent useful for treatment of an IL-36-mediated disease or condition. In some embodiments, for example wherein the disease indication is cancer the therapeutic agent is a chemotherapeutic agent appropriate for the particular cancer. In some embodiments, the further therapeutic agent in the composition is an antagonist of an IL-1, IL-33, IL-36 signaling pathway.

In some embodiments, the compositions or formulations of the present disclosure comprise an anti-IL-36 antibody as the sole active agent, wherein the anti-IL-36 antibody is a multispecific antibody that binds to each of human IL-36α, IL-36β, and IL-36γ with a binding affinity of 3 nM or less, optionally, wherein the binding affinity is measured by equilibrium dissociation constant ($K_D$) to a hu-IL-36α of SEQ ID NO:1, a hu-IL-36β of SEQ ID NO:2, and a hu-IL-36γ of SEQ ID NO:3. In some embodiments, the multispecific antibody comprises a specificity for IL-36α and/or IL-36γ in one arm, and a specificity for IL-36β in the other arm; optionally, wherein one arm binds to hu-IL-36α and hu-IL-36-γ with a binding affinity of $1\times10^{-9}$ M or less, $1\times10^{-10}$ M or less, or $1\times10^{-11}$ M or less, and the other arm binds to hu-IL-36-β with a binding affinity of $1\times10^{-9}$ M or less, $1\times10^{-10}$ M or less, or $1\times10^{-11}$ M or less.

In some embodiments, the compositions or formulations of the present disclosure comprise a single multispecific antibody that binds to each of human IL-36α, IL-36β, and IL-36γ with a binding affinity of 3 nM or less, and does not include any other anti-IL-36 antibody, or any other antibody capable of binding IL-36.

Pharmaceutically acceptable carriers are generally non-toxic to recipients at the dosages and concentrations employed. A wide range of such pharmaceutically acceptable carriers are well-known in the art (see e.g., Remington's Pharmaceutical Sciences 16th edition, Osol, A. Ed. (1980)). Exemplary pharmaceutically acceptable carriers useful in the formulations of the present disclosure can include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides: proteins, such as serum albumin, gelatin, or immunoglobulins; hydrophilic polymers such as polyvinylpyrrolidone; amino acids such as glycine, glutamine, asparagine, histidine, arginine, or lysine: monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as polyethylene glycol (PEG).

Pharmaceutically acceptable carriers useful in the formulations of the present disclosure can also include interstitial drug dispersion agents, such as soluble neutral-active hyaluronidase glycoproteins (sHASEGP) (see e.g., US Pat. Publ. Nos. 2005/0260186 and 2006/0104968), such as human soluble PH-20 hyaluronidase glycoproteins (e.g., rHuPH20 or HYLENEX®, Baxter International, Inc.).

Additional therapeutic agents and active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

In some embodiments, the formulation can be a sustained-release preparation of the antibody and/or other active ingredients. Suitable examples of sustained-release preparations include semipermeable matrices of solid hydrophobic polymers containing the antibody, which matrices are in the form of shaped articles, e.g. films, or microcapsules.

Typically, the formulations of the present disclosure to be administered to a subject are sterile. Sterile formulations may be readily prepared using well-known techniques, e.g., by filtration through sterile filtration membranes.

IV. Uses and Methods of Treatment

It is contemplated that any of the compositions or formulations comprising an anti-IL-36 antibody of the present disclosure can be used for any methods or uses, such as in therapeutic methods, that utilize their ability to specifically bind to IL-36 and/or block the activity of IL-36, particularly blocking the ability of IL-36 to mediate intracellular signaling by the cytokines IL-36α, IL-36β, and/or IL-36γ. The intracellular signaling pathways mediated by IL-36 include at least the signaling pathways stimulated by the cytokine agonists IL-36α, IL-36β, and/or IL-36γ. Inhibition of the IL-36-mediated signaling pathways can be assayed in vitro using known cell-based blocking assays including the HEK-BLUE™ reporter cell assays and primary cell-based blocking assays described in the Examples of the present disclosure.

An IL-36 mediated disease can include any disease or condition associated with the aberrant function of the IL-1 family of cytokines for which IL-36R acts as a receptor including IL-36α, IL-36β, and/or IL-36γ. In some cases, such aberrant function is associated with elevated levels of IL-36α, IL-36β, and/or IL-36γ in bodily fluids or tissue, and can include, for example, levels that exceed those normally found in a particular cell or tissue or can be any detectable level in a cell or tissue that normally does not express these cytokines. Typically, IL-36 mediated conditions or diseases exhibit the following characteristics: (1) pathologies associated with the condition or disease can be experimentally induced in animals by administration of IL-36α, IL-36β, and/or IL-36γ, and/or by up-regulation of expression of IL-36α, IL-36β, and/or IL-36γ; and (2) pathologies associated with the condition or disease generated in experimental animal models can be inhibited by agents that are known to inhibit the action of IL-36α, IL-36β, and/or IL-36γ.

IL-36α, IL-36β, and/or IL-36γ are known to be pro-inflammatory cytokines, however, the aberrant function of the IL-36 signaling pathways stimulated by these cytokines as mediated by IL-36R, are known to be associated with a wide range of diseases and conditions generally including but not limited to inflammatory diseases, autoimmune diseases, respiratory diseases, metabolic disorders, infections, and cancers. For example, the range of conditions and diseases associated with aberrant function of IL-36 signaling, include but are not limited to: acute generalized exanthematous pustulosis (AGEP), chronic obstructive pulmonary disease (COPD), childhood pustular dermatosis, Crohn's disease, eczema, generalized pustular psoriasis (GPP), inflammatory bowel disease (IBD), palmoplantar pustular psoriasis (PPP), psoriasis, psoriatic arthritis, TNF-induced psoriasis form skin lesions in Crohn's patients, Sjogren's syndrome, systemic lupus erythematosus (SLE), ulcerative colitis, and uveitis.

Agents that target the IL-36 signaling pathways by blocking IL-36R are in clinical development for the treatment of a range of diseases and conditions, including but not limited to the following: GPP, PPP, and ulcerative colitis.

It is contemplated that any of the compositions or formulations comprising an anti-IL-36 antibody of the present disclosure can be used in a method or use for the treatment of any of the above-listed diseases or conditions associated with aberrant function of the IL-36 signaling pathway. Generally, these conditions and diseases include but are not limited to inflammatory diseases, autoimmune diseases, respiratory diseases, metabolic disorders, infections, and cancers.

Accordingly, in some embodiments, the compositions or formulations comprising an anti-IL-36 antibody of the present disclosure can be used in a method, therapy, medicament, diagnostic, or use for use in the treatment of a condition or disease selected from acne due to epidermal growth factor receptor inhibitors, acne and suppurative hidradenitis (PASH), acute generalized exanthematous pustulosis (AGEP), amicrobial pustulosis of the folds, amicrobial pustulosis of the scalp/leg, amicrobial subcorneal pustulosis, aseptic abscess syndrome, Behçet's disease, bowel bypass syndrome, chronic obstructive pulmonary disease (COPD), childhood pustular dermatosis, Crohn's disease, deficiency of the interleukin-1 receptor antagonist (DIRA), deficiency of interleukin-36 receptor antagonist (DITRA), eczema, generalized pustular psoriasis (GPP), erythema elevatum diutinum, hidradenitis suppurativa, IgA pemphigus, inflammatory bowel disease (IBD), neutrophilic panniculitis, palmoplantar pustular psoriasis (PPP), psoriasis, psoriatic arthritis, pustular psoriasis (DIRA, DITRA), pyoderma gangrenosum, pyogenic arthritis pyoderma gangrenosum and acne (PAPA), pyogenic arthritis pyoderma gangrenosum acne and suppurative hidradenitis (PAPASH), rheumatoid neutrophilic dermatosis, synovitis acne pustulosis hyperostosis and osteitis (SAPHO), TNF-induced psoriasis form skin lesions in Crohn's patients, Sjogren's syndrome, Sweet's syndrome, systemic lupus erythematosus (SLE), ulcerative colitis, and uveitis.

As disclosed herein, including in the Examples below, the anti-IL-36 antibodies of the present disclosure have the ability to decrease, inhibit, and/or block intracellular signaling mediated by IL-36. Accordingly, in some embodiments, the present disclosure provides a method of treating a IL-36-mediated disease or condition in a subject, the method comprising administering to the subject a therapeutically effective amount of an anti-IL-36 antibody of the present disclosure or administering to a subject in need thereof a therapeutically effective amount of a pharmaceutical composition comprising an anti-IL-36 antibody of the present disclosure and a pharmaceutically acceptable carrier.

As disclosed elsewhere herein, the anti-IL-36 antibodies of the present disclosure have the ability to decrease, inhibit, and/or block the IL-36 signaling pathways. Accordingly, the present disclosure also provides methods of treating diseases and conditions responsive to a decrease, inhibition, and/or blocking of the IL-36 signaling pathways.

Additionally, the anti-IL-36 antibodies of the present disclosure have the ability to decrease, inhibit, and/or block intracellular signaling stimulated by the agonists IL-36α, IL-36β, and/or IL-36γ. Accordingly, the present disclosure also provides methods of treating diseases and conditions responsive to a decrease, inhibition, and/or blocking of intracellular signaling stimulated by the agonists IL-36α, IL-36β, and/or IL-36γ.

The IL-1 family cytokines, including the IL-36 cytokines, IL-36α, IL-36β, and/or IL-36γ, are involved in inflammatory immune responses that affect tumor formation and the development of many forms of cancer. Accordingly, in some embodiments, the present disclosure provides a method of treating cancer in a subject, the method comprising administering to the subject in need thereof a therapeutically effective amount of an anti-IL-36 antibody of the present disclosure or administering to a subject a therapeutically effective amount of a pharmaceutical composition comprising an anti-IL-36 antibody of the present disclosure and a pharmaceutically acceptable carrier.

The IL-36 signaling pathways have been associated with psoriasis. Accordingly, in some embodiments, the present disclosure provides a method of treating psoriasis in a subject, the method comprising administering to the subject in need thereof a therapeutically effective amount of an anti-IL-36 antibody of the present disclosure or administering to a subject a therapeutically effective amount of a pharmaceutical composition comprising an anti-IL-36 antibody of the present disclosure and a pharmaceutically acceptable carrier.

In some embodiments, the present disclosure provides a method of treating and/or preventing a IL-36-mediated disease, a IL-36 signaling pathway mediated disease, and/or a disease mediated by intracellular signaling stimulated by the agonists IL-36α, IL-36β, and/or IL-36γ. In such method of treatment embodiments, the method comprises administering to a subject in need thereof, a therapeutically effective amount of an anti-IL-36 antibody, or a composition or pharmaceutical formulation comprising an anti-IL-36 antibody as described herein. Administration of the antibody, composition, or pharmaceutical formulation in accordance with the method of treatment provides an antibody-induced therapeutic effect that protects the subject from and/or treats the progression of an IL-36-mediated disease in a subject.

In some embodiments, the anti-IL-36 antibody is the sole active agent that is administered to the subject. In some embodiments wherein the anti-IL-36 antibody is the sole active agent, the anti-IL-36 antibody is a multispecific antibody that binds to each of human IL-36α, IL-36β, and IL-36γ with a binding affinity of 3 nM or less. Such a method that uses a single anti-IL-36 antibody as the sole active agent provides an advantage over methods that require the use of multiple anti-IL-36 antibodies (e.g., a composition comprising a mixture of two or more different antibodies that bind to IL-36α, IL-36-β, and/or IL-36γ), and/or other antibodies that bind to other antigens. The ability to bind all three IL-36 antigens with a single antibody allows for administration of a single composition or formulation, including a single dose or multiple doses of a single composition or formulation, to the subject. Additionally, it is contemplated that the number of doses administered using the multispecific antibody is fewer that when administering multiple different anti-IL-36 antibodies or mixtures of anti-IL-36 and/or other antibodies.

In some embodiments, the method of treatment can further comprise administration of one or more additional therapeutic agents or treatments known to those of skill in the art to prevent and/or treat the IL-36-mediated disease or condition. Such methods comprising administration of one or more additional agents can encompass combined administration (where two or more therapeutic agents are included in the same or separate formulations), and separate administration, in which case, administration of the antibody composition or formulation can occur prior to, simultaneously, and/or following, administration of the additional therapeutic agent.

In some embodiments of the methods of treatment of the present disclosure, the anti-IL-36 antibody or pharmaceutical formulation comprising an anti-IL-36 antibody is administered to a subject by any mode of administration that delivers the agent systemically, or to a desired target tissue. Systemic administration generally refers to any mode of administration of the antibody into a subject at a site other than directly into the desired target site, tissue, or organ, such that the antibody or formulation thereof enters the subjects circulatory system and, thus, is subject to metabolism and other like processes.

Accordingly, modes of administration useful in the methods of treatment of the present disclosure can include, but are not limited to, injection, infusion, instillation, and inhalation. Administration by injection can include intravenous, intramuscular, intraarterial, intrathecal, intraventricular, intracapsular, intraorbital, intracardiac, intradermal, intraperitoneal, transtracheal, subcutaneous, subcuticular, intraarticular, subcapsular, subarachnoid, intraspinal, intracerebrospinal, and intrasternal injection and infusion.

In some embodiments, a pharmaceutical formulation of the anti-IL-36 antibody is formulated such that the antibody is protected from inactivation in the gut. Accordingly, the method of treatments can comprise oral administration of the formulation.

In some embodiments, use of the compositions or formulations comprising an anti-IL-36 antibody of the present disclosure as a medicament are also provided. Additionally, in some embodiments, the present disclosure also provides for the use of a composition or a formulation comprising an anti-IL-36 antibody in the manufacture or preparation of a medicament, particularly a medicament for treating, preventing or inhibiting an IL-36-mediated disease. In a further embodiment, the medicament is for use in a method for treating, preventing or inhibiting an IL-36-mediated disease comprising administering to an individual having an IL-36-mediated disease an effective amount of the medicament.

In some embodiments, the compositions and formulations useful as a medicament or in the preparation of a medicament comprise an anti-IL-36 antibody as the sole active agent. In some embodiments, the anti-IL-36 antibody useful as a medicament or in the preparation of a medicament is a multispecific antibody that binds to each of human IL-36α, IL-36β, and IL-36γ with a binding affinity of 3 nM or less. In such embodiments, the use of a single, multispecific, anti-IL-36 antibody as the sole active agent in a medicament, or in the preparation of a medicament, provides a distinct advantage over uses that require multiple anti-IL-36, or other antibodies. The use of a single multispecific anti-IL-36 antibody comprising binding specificities for IL-36α, IL-36β, and IL-36γ allows for simplified uses because only a single active agent is included in the composition or formulation is used.

In certain embodiments, the medicament further comprises an effective amount of at least one additional therapeutic agent, or treatment.

In a further embodiment, the medicament is for use in treating, inhibiting or preventing an IL-36-mediated disease in a subject comprising administering to the subject an amount effective of the medicament to treat, inhibit or prevent the IL-36-mediated disease.

For the prevention or treatment of a IL-36-mediated disease or condition, the appropriate dosage of the anti-IL-36 antibody contained in the compositions and formulations of the present disclosure (when used alone or in combination with one or more other additional therapeutic agents) will depend on the specific disease or condition being treated, the severity and course of the disease, whether the antibody is administered for preventive or therapeutic purposes, the previous therapy administered to the patient, the patient's clinical history and response to the antibody, and the discretion of the attending physician. The anti-IL-36 antibody included in the compositions and formulations described herein, can be suitably administered to the patient at one time, or over a series of treatments. Various dosing schedules including but not limited to single or multiple administrations over various time-points, bolus administration, and pulse infusion are contemplated herein.

Depending on the type and severity of the disease, about 1 µg/kg to 15 mg/kg of anti-IL-36 antibody in a formulation of the present disclosure is an initial candidate dosage for administration to a human subject, whether, for example, by one or more separate administrations, or by continuous infusion. Generally, the administered dosage of the antibody would be in the range from about 0.05 mg/kg to about 10 mg/kg. In some embodiments, one or more doses of about 0.5 mg/kg, 2.0 mg/kg, 4.0 mg/kg or 10 mg/kg (or any combination thereof) may be administered to a patient.

Dosage administration can be maintained over several days or longer, depending on the condition of the subject, for example, administration can continue until the IL-36-mediated disease is sufficiently treated, as determined by methods known in the art. In some embodiments, an initial higher loading dose may be administered, followed by one or more lower doses. However, other dosage regimens may be useful. The progress of the therapeutic effect of dosage administration can be monitored by conventional techniques and assays.

Accordingly, in some embodiments of the methods of the present disclosure, the administration of the anti-IL-36 antibody comprises a daily dosage from about 1 mg/kg to about 100 mg/kg. In some embodiments, the dosage of anti-IL-36 antibody comprises a daily dosage of at least about 1 mg/kg, at least about 5 mg/kg, at least about 10 mg/kg, at least about 20 mg/kg, or at least about 30 mg/kg.

Additionally, the anti-IL-36 antibodies of the present disclosure may be used in assay methods for the detection of IL-36. Due to their ability to bind human IL-36 with high affinity, the anti-IL-36 antibodies disclosed herein are appropriate for a wide range of assay methods and formats. It is contemplated that the anti-IL-36 antibodies can be employed in any known assay method, such as competitive binding assays, direct and indirect sandwich assays, immunoprecipitation assays and enzyme-linked immunosorbent assays (ELISA) (See, Sola, 1987, Monoclonal Antibodies: A Manual of Techniques, pp. 147-158, CRC Press, Inc.) for the detection and quantitation of IL-36. Accordingly, in some embodiments, the present disclosure provides a method for detecting the level of IL-36 in a biological sample, the method comprising the step of contacting the sample with an anti-IL-36 antibody as disclosed herein. Further, in some embodiments, it is contemplated that the method of detecting the level of IL-36 in a biological sample can be used for detecting and/or diagnosing an IL-36-mediated condition or disease in a biological sample, e.g., from a human subject.

EXAMPLES

Various features and embodiments of the disclosure are illustrated in the following representative examples, which are intended to be illustrative, and not limiting. Those skilled in the art will readily appreciate that the specific examples are only illustrative of the invention as described more fully in the claims which follow thereafter. Every embodiment and feature described in the application should be understood to be interchangeable and combinable with every embodiment contained within.

Example 1: Generation of IL-36 Polypeptides

This example illustrates the preparation of the various IL-36 polypeptide constructs used as antigens in eliciting and screening the anti-IL-36 antibodies of the present disclosure.

The active, N-terminally truncated forms of human IL-36α, IL-36β, IL-36γ, IL-36Ra (hu-IL-36α, hu-IL-36β, hu-IL-36γ, hu-IL-36Ra) and cynomolgus monkey IL-36α, IL-36β, IL-36γ (cy-IL-36α, cy-IL-36β, cy-IL-36γ) were produced recombinantly based upon information in Towne et al., (2011). The amino acid sequence boundaries of the expression constructs are provided above in Table 1 and the accompanying Sequence Listing. All of the recombinant IL-36α and IL-36β polypeptide constructs had an N-terminal "12×His-SUMO" tag for purification purposes (SEQ ID NO: 8). The construct of IL-36γ had the following "12×His-TEV" N-terminal tag for purification purposes: HHHHHHHHHHHHENLYFQS (SEQ ID NO: 9). The construct of IL-36Ra had the following C-terminal "GS-TEV-GS-huIgG1Fc-FLAG" tag for purification purposes (SEQ ID NO: 12) along with an N-terminal secretion signal sequence for mammalian cell expression: MGWSCIILFL-VATATGVHS (SEQ ID NO: 11). As noted elsewhere herein, for some applications, the IL-36 constructs included the following C-terminal "GS-AviTag" (IL-36-Avi) for detection or capture purposes: GGGGSGLNDIFEAQKIEWHE (SEQ ID NO: 10).

The IL-36 construct proteins were expressed in One Shot BL21(DE3) Chemically Competent E. coli (Thermo Fisher, Waltham, MA, USA) according to the manufacturer's protocol. Standard IPTG (1 mM) induction protocols were performed in LB broth with Kanamycin (25 ug/mL) selection. Following induction, cells were grown at 25 degrees Celsius for 20-24 hours and harvested as pellets. Standard sonication procedures in lysozyme (100 ug/mL) and protease inhibitors were performed to extract soluble protein from E. coli pellets. Clarified supernatants were supplemented with 20 mM imidazole pH 7.5 and applied to HisTrap FF crude columns (GE Healthcare, Chicago, IL, USA) equilibrated in 20 mM Tris-HCl, 150 mM NaCl (TBS), 20 mM imidazole pH 7.5. Proteins were eluted with a 10 CV gradient to 100% TBS, 500 mM imidazole pH 7.5. Mature forms of IL-36 protein constructs were generated after cleaving N-terminal fusion tags with either His-SUMO protease (Thermo Fisher, Waltham, MA, USA) or His-TEV protease (ATUM, Newark, CA, USA) according to the manufacturer's protocol with the following modifications: SUMO protease was pre-treated with 10 mM DTT for 5 minutes and then used in reactions (~0.02 units per µg substrate) containing TBS pH 7.5 with 10 mM DTT at 25 degrees Celsius for 18-24 hours; TEV protease was used in reactions (50 µg/mL) at 25 degrees Celsius for 2 hours. Following protease treatment, affinity purification was performed using HisTrap FF columns to remove the cleaved tags, and flow-through fractions were retained and then loaded onto Superdex 75 increase columns (GE Healthcare, Chicago, IL, USA). Peak fractions containing monomeric protein were pooled and stored in 25 mM HEPES, 150 mM NaCl (HBS), pH 7.5, 0.02% NaN$_3$.

The C-terminal Fc-fused IL-36Ra protein was expressed in Expi293F cells (Thermo Fisher Scientific, Waltham, MA, USA) according to the manufacturer's protocol. Cells were harvested after 6 days and the clarified supernatant was applied to MabSelect SuRe columns (GE Healthcare, Chicago, IL, USA) equilibrated in TBS. Protein was eluted in 20 mM citrate pH 2.95, 150 mM NaCl (CBS) and immediately neutralized with 1/25 volume 1.5 M Tris-HCl pH 8.8. The C-terminal Fc tag was removed using His-TEV protease as previously described, followed by affinity purification using a combination of HisTrap FF and MabSelect SuRe columns to remove the purification tags and His-TEV protease. Subsequent purification of the flow-through fraction proceeded as previously described for IL-36 proteins.

For some applications IL-36 proteins were biotinylated randomly or site-specifically. For random biotinylation of IL-36 proteins, NHS-PEG4-biotin (Thermo Fisher, Waltham, MA, USA) was used according to the manufacturer's instructions. For site-specific biotinylation of IL-36-Avi proteins, E. coli were co-transformed with plasmids expressing IL-36-Avi and BirA biotin ligase (pBirAcm plasmid from Avidity, Aurora, CO, USA). IPTG inductions were carried out as previously described with the addition of Chloramphenicol (10 ug/mL) during the starter culture step for double-selection with the BirA gene and 50 uM d-biotin during the induction step for in-vivo biotinylation.

Example 2: Generation of Anti-Human IL-36 Antibodies Using Yeast Display Methods, Screening and Selection for Further Characterization A. Selection of Anti-hu-IL-36 Antibodies by Yeast Display Human IL-36α (BioLegend), human IL-36β (Novus) and human IL-36γ (Novus) were commercially obtained as N-terminally truncated (active) forms. For yeast selection and screening purposes, these IL-36 proteins were biotinylated using NHS-PEG4-Biotin (Pierce) or labeled with DyLight-650 using NHS-4×PEG-Dylight-650 (Thermo Scientific) according to the manufacturers' protocols aiming for a ratio of label:protein of between 1-3 to 1.

Antibodies recognizing hu-IL-36 were generated using human antibody libraries displayed on the surface of yeast (U.S. Pat. No. 10,011,829). Yeast display libraries were generated to display Fab fragments based on 5 VH, 4Vκ and one Vλ gene segments according to the methods described in U.S. Pat. No. 10,011,829, which is hereby incorporated by reference herein in its entirety. 25 sub-libraries were rationally designed in order to improve amino acid diversity in the CDRs while retaining the germline sequences in the antibody framework regions. The amino acid usage in the engineered CDRs was matched to that observed for those variable region subfamilies in a human antibody database generated from a deep sequencing dataset with over 350,000 naturally occurring human antibody clones. The methods for using the libraries to identify antibodies capable of binding hu-IL-36, including methods for amplifying the libraries or yeast cells harvested from an enrichment or sorting process and induction of antibody expression on the surface of yeast for FACS sorting with antigens, were carried out as described in U.S. Pat. No. 10,011,829.

The master human antibody library comprised of individual libraries based on different VH-Vκ or VH-Vλ combinations was split into two pools (libraries 1-13 and libraries 14-25) to enable efficient initial enrichment for clones recognizing hu-IL-36 by magnetic-activated cell sorting (MACS). The libraries were grown up to 3-fold the original library titer and induced for antibody expression by growing the yeast with induction medium containing 2% galactose at 20° C. Three rounds of MACS were performed and harvested cells from each round were amplified such that 10-fold the number of yeast cells harvested was used for the next round of MACS.

For MACS selection biotinylated hu-IL-36α, hu-IL-36β and hu-IL-36γ proteins were pooled together. In three successive rounds of MACS enrichment, each library yeast cell pool was incubated with 300 nM each of biotinylated hu-IL-36α, hu-IL-36β and hu-IL-36γ. After incubation at 4° C. with rotation for 2 hours, cells were washed and 3 mL of streptavidin-coated magnetic beads (Miltenyi Biotec, Auburn, CA) were added to each pool. After 1 hour incubation at 4° C. with rotation, antigen-binding cells were sorted by magnetic activated bead sorting using LS columns (Miltenyi Biotec, Auburn, CA). The harvested cells from the two library pools were collected, pooled, amplified 10-fold overnight and then subjected to a second MACS selection that included a pre-clearing depletion with baculovirus and streptavidin-coated beads before incubating the remaining yeast cells with 300 nM of each of the 3 biotinylated hu-IL-36 cytokines. The percent of the input pool harvested from the third round of MACS was 9.7%.

Prior to performing FACS sorting experiments to identify high-affinity yeast clones for hu-IL-36 proteins, different binding buffers were tested to minimize non-specific binding. The best binding buffer for hu-IL-36α and hu-IL-36β was PBS containing 0.5% bovine serum albumin (VWR Life Science, Radnor, PA, USA), whereas experiments with hu-IL-36γ required PBS containing filtered, solubilized 5% dried milk (LabScientific, Highlands, NJ, USA) to minimize background binding.

FACS1 was performed using 150 nM of each PEG4-biotin-IL-36 cytokine in separate aliquots containing the selected binding buffer and using streptavidin-PE as a secondary detection reagent. Antigen-positive cells were collected, amplified 10-fold and used for two additional rounds of FACS (FACS2 and FACS3) using hu-IL-36 proteins labeled with PEG-Dylight-650 and the same buffer conditions as in FACS1. The percent antigen-positive cells harvested in FACS3 were 2.3% for hu-IL-36α, 1.0% for hu-IL-36β, and 11.4% for hu-IL-36γ. 0.2% of the antigen-positive cells with the highest mean fluorescence intensity were plated and individual clones were picked into deep-well plates and cultured for 48 hours with induction media to induce secretion of Fab fragments into the culture supernatant. Yeast cultures were harvested, cells removed by centrifugation and Fab-containing supernatants were then tested for binding activity to their respective antigens by ELISA.

For ELISAs with yeast culture supernatants, 96-well ELISA plates were coated with 250 ng/well neutravidin, blocked with PBS containing 0.5% BSA ("blocking buffer") and then 250 ng of biotinylated hu-IL-36α, hu-IL-36β or hu-IL-36γ was added per well. After washing, 20 µL culture media and 30 µL blocking buffer was added, the plates incubated with rocking for 1 hour at room temperature, washed and bound Fab detected with anti-human-Fab HRP. The majority of clones from these single cytokine sorts exhibited binding activity to the hu-IL-36 cytokine they were selected against in this primary ELISA. In secondary ELISAs testing binding activity for all three hu-IL-36 cytokines, clones that bound to both hu-IL-36α and hu-IL-36γ (but not hu-IL-36β) were observed. Therefore, two FACS sorting strategies were pursued to identify hu-IL-36α/γ-crossreactive clones.

Identification and Selection of hu-IL-36α/hu-IL-36γ-Crossreactive Antibodies

In the first sorting strategy used to select clones that could recognize both hu-IL-36α and hu-IL-36γ, cells obtained in FACS3 with 150 nM PEG-Dylight-650-huIL-36α (2.3% antigen-positive) were amplified 10-fold and sorted with 100 nM PEG4-biotin-IL-36α, yielding 15.5% antigen-positive cells (FACS4). These cells were amplified and stained with 100 nM PEG-Dylight-650-huIL-36γ, yielding 29.1% antigen-positive cells (FACS5AG). Cells collected in FACS5AG were amplified 10-fold and stained with 10 nM PEG-Dylight-650-huIL-36γ and 10 nM PEG4-biotin-IL-36α (detected with streptavidin-PE), yielding 7.3% IL-36α/γ-double-positive cells (FACS6AG). Cells collected in FACS6AG were amplified 10-fold and stained with 10 nM PEG-Dylight-650-huIL-36α and 10 nM PEG4-biotin-IL-36γ (detected with streptavidin-PE), yielding 1.0% IL-36α/γ-double-positive cells (FACS7AG).

In the second sorting strategy used to select clones that could recognize both hu-IL-36α and hu-IL-36γ, cells obtained in FACS3 with 150 nM PEG-Dylight-650-huIL-36γ (11.4% antigen-positive) were amplified 10-fold and sorted with 100 nM PEG4-biotin-IL-36α, selecting antigen-positive cells (FACS4GA). These cells were amplified and stained with 100 nM PEG-Dylight-650-huIL-36α and 100 nM PEG4-biotin-IL-36γ (detected with streptavidin-PE), yielding 1.0% IL-36α/γ-double-positive cells (FACS5GA). Cells collected in FACS5GA were amplified 10-fold and stained with 100 nM PEG4-biotin-huIL-36α (detected with streptavidin-PE) and 100 nM PEG-Dylight-650-huIL-36γ, yielding 8.0% IL-36α/γ-double-positive cells (RFACS6GA). Cells collected in RFACS6GA were amplified 10-fold and stained with 100 nM PEG-Dylight-650-huIL-36α and 100 nM PEG4-biotin-IL-36γ (detected with streptavidin-PE), yielding 1.3% IL-36α/γ-double-positive cells (RFACS7GA).

0.2% of the IL-36α/γ-double-positive cells from FACS7AG and RFACS7GA with the highest mean fluorescence intensity were plated, individual clones were picked and cultured, and Fab-containing supernatants were then tested for binding activity to hu-IL-36α and hu-IL-36γ by ELISA as described above. 87 clones that bound both hu-IL-36α and hu-IL-36γ were selected for sequencing.

To obtain the antibody sequence for the selected yeast clones, plasmid DNA was extracted from the yeast clones and used for PCR using a forward primer that binds to the yeast promoter region and reverse primers that bind to the constant region of the human IgG1-CH1 region for the heavy chain and the constant region of the kappa or lambda chain for the light chain. The PCR products were then sequenced by Sanger sequencing using the same primers used for the PCR reaction.

The 87 hu-IL-36α/γ cross-reactive clones represented 30 unique clones by sequence.

Identification and Selection of hu-IL-36β-Reactive Antibodies

In the sorting strategy used to select clones that could recognize hu-IL-36β, cells obtained in FACS3 with 150 nM PEG-Dylight-650-huIL-36β (1.0% antigen-positive) were amplified 10-fold and sorted with 100 nM PEG4-biotin-IL-36β and detected with streptavidin-PE, yielding 13.1% antigen-positive cells (FACS4B). These cells were amplified and stained with 20 nM PEG-Dylight-650-huIL-36β, yielding 5.8% IL-36β-positive cells (FACS5B).

0.2% of the IL-36β-positive cells from FACS5B with the highest mean fluorescence intensity were plated, individual clones were picked and cultured, and Fab-containing supernatants were then tested for binding activity to their respective antigens by ELISA as described above. The majority of the clones from this sort exhibited binding activity to IL-36β.

A total of 83 IL36BS7 clones were sequenced as described above, yielding 8 unique clones.

B. In Vitro Screening of Yeast Cell Supernatants Containing Anti-hu-IL-36 Antibodies Cell supernatants from yeast clones of interest were tested for binding to human IL-36 by ELISA as described above. To compare the binding of these supernatants to human and cynomolgus monkey IL-36, IL-36 proteins were coated at 2.5 μg/mL on 96-well Nunc MaxiSorp plates (Thermo Fisher) and the plates blocked with 5% goat serum in PBS. Yeast supernatants were diluted 1:1 with PBST containing 1% w/v BSA and added to the ELISA plates for 1-1.5 hours with agitation. Bound Fab was detected by incubating the plates with F(ab')2-HRP (Jackson ImmunoResearch). The ELISAs were developed for 3-10 minutes by addition of 50 μL/well of tetramethybenzidine (TMB) microwell peroxidase substrate (Scytek Laboratories, Inc., Logan, UT, USA) and enzymatic color development was stopped by acidification with 50 μL/well of 2 N $H_2SO_4$ (Sigma-Aldrich Corporation, St. Louis, MO, USA). The optical density of the samples at a wavelength of 450 nm (OD450) was analyzed with a SpectraMax i3X plate reader (Molecular Devices LLC, San Jose, CA, USA). To estimate the relative affinity of each clone for cynomolgus monkey IL-36 and human IL-36 in this assay, a ratio of OD450 ($OD450_{cyIL-36}$/$OD450_{huIL-36}$) was calculated for each clone and IL-36 cytokine. Eight anti-IL-36 Fab clones (mAb1.0-mAb8.0) were selected for further characterization and results are shown in Table 3.

TABLE 3

Binding of selected anti-IL-36 Fabs to hu-IL-36 and cy-IL-36 by ELISA.

| | ELISA $OD_{450}$ | | | ELISA $OD_{450}$cyIL-36/ $OD_{450}$hu-IL-36 | | |
|---|---|---|---|---|---|---|
| Antibody | hu-IL-36α | hu-IL-36β | hu-IL-36γ | IL-36α | IL-36β | IL-36γ |
| mAb1.0 | 0.9398 | 0.0523 | 2.4295 | 0.6 | N.T. | 1.3 |
| mAb2.0 | 2.5315 | 0.0604 | 2.5023 | 0.7 | N.T. | 1.2 |
| mAb3.0 | 1.6265 | 0.1097 | 2.1116 | 0.5 | N.T. | 1.0 |
| mAb4.0 | 2.1644 | 0.0513 | 2.2984 | 0.5 | N.T. | 1.2 |
| mAb5.0 | 2.0511 | 0.1285 | 2.077 | 0.5 | N.T. | 1.0 |
| mAb6.0 | 0.0638 | 2.3414 | 0.0656 | N.T. | 4.0 | N.T. |
| mAb7.0 | 0.0604 | 2.5818 | 0.0724 | N.T. | 3.9 | N.T. |
| mAb8.0 | 0.0698 | 2.6319 | 0.073 | N.T. | 0.1 | N.T. |

N.T. = not tested

C. Cell-Based Assay to Determine Blocking Potency of Fab Supernatants

HEK-Blue cell lines, described in this and the following examples, use the HEK-293 cell line (human embryonic kidney epithelial cells) as the original parental lineage. The HEK-Blue IL-1/IL-33 sensor cells, were obtained from InvivoGen (InvivoGen, San Diego, CA, USA; catalog #hkb-il33). These IL-1/IL-33 sensor cells were generated by stable transfection of HEK-Blue IL-1P sensor cells (InvivoGen; catalog #hkb-il1b) with the human ST2 gene expressing the IL-33 receptor ST2. HEK-Blue IL-1β cells express an NF-κB/AP-1 SEAP (secreted embryonic alkaline phosphatase) reporter gene and contain an inactivated TNF-α response to ensure SEAP production is representative of IL-1 or IL-33 pathway activation. The HEK-Blue IL-1/IL-33 responsive cells were maintained according to manufacturer guidelines. Briefly, the cells were maintained in a standard growth medium consisting of DMEM (Corning, Inc., Corning, NY, USA), supplemented with 10% fetal bovine serum (FBS) (Atlanta Biologicals, Inc., Flowery Branch, GA, USA), 100 IU/mL penicillin and 100 μg/mL streptomycin. The growth medium was further supplemented with 100 μg/mL zeocin to maintain the plasmid coding for SEAP, 200 μg/mL hygromycin B to maintain IL-1 specificity and 100 μg/mL blasticidin to maintain the plasmid encoding ST2. The plasmid containing the human IL1 RL2 gene, encoding the IL-36 receptor, was generated by AvantGen (custom order). HEK-Blue IL-1/IL-33 sensor cells were transiently transfected using LyoVec (InvivoGen) according to manufacturer guidelines. Briefly, LyoVec-DNA complexes were added directly to cells suspended in standard growth medium, at a concentration that would produce a minimum of 80% confluency 24 hours post-transfection, and immediately plated on 96-well, flat-bottom plates. 24 hours post-transfection, the cells were used within a standard HEK-Blue SEAP assay.

An agonist dose-response curve, consisting of a serial dilution series, was generated to provide an estimate of the half maximal effective concentration ($EC_{50}$) of agonist to be used in the assay. The following commercially available human cytokines were used as agonists in some HEK-Blue assays: IL-36α (BioLegend), IL-36β (Novus Biologicals) and IL-36γ (Novus Biologicals). 24 hours prior to experimental use, the transiently transfected cells were plated on 96-well, flat-bottom plates at a concentration resulting in a minimum of 80% confluency at the time of use. The desired agonist was added to the cells to a final volume 200 μL and the cells incubated for 24 hours at 37° C. with 5% $CO_2$. SEAP production was quantified using a SEAP detection assay. The SEAP detection medium QUANTI-Blue (InvivoGen) was used to determine the level of SEAP within the various conditions indicated and per general manufacturer guidelines. Specifically, 20 μL of cell culture supernatant (collected 24 hours post-agonist addition) was added to 130 μL of QUANTI-Blue detection medium. The reaction was allowed to proceed for one hour at 37° C., at which point a SpectraMax (Molecular Devices) spectrophotometer was used to measure the absorbance at a wavelength of 650 nm in conjunction with SoftMax Pro software (Molecular Devices). The raw assay data was analyzed using GraphPad Prism 7 software to perform a non-linear regression determination of the agonist $EC_{50}$ value in the assay.

HEK-Blue SEAP assays of non-purified anti-hu-IL-36 Fab fragments in yeast cell culture supernatant (SN) were performed as described above but with the following modifications. Non-purified, yeast cell culture SN containing the anti-hu-IL-36 Fab fragments was concentrated 20-fold and buffer-exchanged into PBS (1:20) to reduce background noise in the HEK-Blue SEAP assay. 40 μL of PBS and 10 μL of concentrated and buffer-exchanged yeast cell culture SN containing the anti-hu-IL-36 Fab fragments was added to HEK-Blue IL-1/IL-33 cells transfected with IL-36R. The cells and antibody-containing hybridoma cell culture SN were incubated for one-hour at 37° C. with 5% $CO_2$. Following the one-hour antibody incubation, the agonist was added to the wells containing the cells and antibodies at 4× the desired concentration, and in a manner resulting in 1× the final desired concentration within a total volume of 200 μL. The percent inhibition was calculated by determining the ratio of the absorbance value obtained from the sample (in this case anti-hu-IL-36 antibody-containing yeast cell culture SN) in relation to the positive control (cells exposed to the agonist only in the presence of yeast cell culture SN containing an irrelevant Fab) and multiplying this ratio by 100.

The results for the 8 anti-IL-36 Fab clones (mAb1.0-mAb8.0) selected for further characterization are shown in Table 4 below. The sequences for the selected clones are also disclosed in Table 2 and the accompanying Sequence Listing.

TABLE 4

Blocking activity of selected anti-IL-36 yeast clone Fab supernatants in HEK Blue cell-based assay

| Yeast Fab supernatant | % Inhibition | | |
|---|---|---|---|
| | hu-IL-36a | hu-IL-36b | hu-IL-36g |
| mAb1.0 | 70 | N.D. | 31 |
| mAb2.0 | 91 | N.D. | 89 |
| mAb3.0 | 40 | N.D. | 64 |
| mAb4.0 | 91 | N.D. | 57 |
| mAb5.0 | 75 | N.D. | 75 |
| mAb6.0 | N.D. | 86 | N.D. |
| mAb7.0 | N.D. | 84 | N.D. |
| mAb8.0 | N.D. | 85 | N.D. |

Based on their observed binding and blocking activities summarized in Tables 3 and 4, five of the IL-36α/IL-36γ-crossreactive antibodies (mAb1.0-mAb5.0) and three of the IL-36β-reactive antibodies (mAb6.0-mAb8.0) were produced as recombinant human IgG1 and cleaved Fab fragments for further characterization. IgGs were produced by transient co-transfection of mammalian expression plasmids encoding their heavy and light chains in Expi293 or ExpiCHO cells (Thermo Fisher Scientific) according to the manufacturer's instructions. Cells were harvested after 5-7 days and the clarified supernatant was applied to MabSelect SuRe columns (GE Healthcare, Chicago, IL, USA) equilibrated in TBS. Protein was eluted in 20 mM citrate pH 2.95, 150 mM NaCl (CBS) and immediately neutralized with ⅕ volume 1.5 M Tris-HCl pH 8.8. Fab fragments and were produced by lysyl-C (Wako Chemicals) cleavage. Briefly, Lysyl-C cleavage was carried out in PBS containing 100 mM Tris pH 8.0 at 37° C. for 1 hour with gentle agitation, and stopped by diluting the reaction 10-fold into 50 mM sodium acetate pH 5.2. The Fab fraction was purified by applying the sample to an SP-HP cation exchange column (GE Healthcare, Chicago, IL, USA) equilibrated in 10 mM sodium acetate pH 5.2 and eluting with a 30 column volume gradient to 100% 10 mM sodium acetate pH 5.2, 1 M NaCl. Fractions containing Fab were pooled, concentrated and buffer-exchanged into PBS.

D. Binding Kinetics Analysis of Selected Anti-IL-36 Antibodies

Surface plasmon resonance (SPR) analysis was used to determine binding affinity for hu-IL-36α and hu-IL-36γ of the purified mAb2.0 Fab; and for hu-IL-36β of the purified mAb6.0 Fab using a BIACORET™ 8K instrument (GE Healthcare, Chicago, IL, USA). Briefly, a 1:4 dilution of Biotin CAPture Reagent (GE Healthcare, Chicago, IL, USA)) into HBS-EP buffer (GE Healthcare, Chicago, IL, USA; 0.01 M HEPES pH 7.4, 0.15 M NaCl, 3 mM EDTA, 0.005% Surfactant P20) was applied to a CAP sensor chip at 2 μL/min flow rate. For kinetics measurements, 12.5 nM biotinylated hu-IL-36α and hu-IL-36γ; 6 nM biotinylated hu-IL-36β was captured at 10 μL/min to achieve 25-40 response units in the second flow cell (FC2). FC1 was kept as a reference. Next, 2-fold serial dilutions of the Fab protein in HBS-P buffer (GE Healthcare, Chicago, IL, USA; 0.01 M HEPES pH 7.4, 0.15 M NaCl, 0.005% surfactant P20) from low (0.78 nM of mAb2.0 Fab, 1.56 nM of mAb6.0 Fab) to high (100 nM of mAb2.0 Fab, 200 nM of mAb6.0 Fab) were injected (flow rate: 30 μL/min) at either 25° C. or 37° C. The sensorgram was recorded and subject to reference and buffer subtraction before data analysis with the BIACORE® 8K Evaluation Software (GE Healthcare, Chicago, IL, USA; version 1.1.1.7442). Association rates ($k_{on}$) and dissociation rates ($k_{off}$) were calculated using a simple one-to-one Langmuir binding model. The equilibrium dissociation constant ($K_D$) was calculated as the ratio of $k_{off}/k_{on}$.

The Biacore affinity results for mAb2.0 Fab and mAb6.0 Fab are summarized below in Table 5.

TABLE 5

Binding affinity of selected anti-IL-36 antibodies at 25° C. and 37° C. ($K_D$, $k_{on}$, $k_{off}$)

1:1 binding fit

| Fab | Biotinylated hu-IL-36 | $K_D$ (nM) | | $k_{on}$ (1/Ms) | | $k_{off}$ (1/s) | |
|---|---|---|---|---|---|---|---|
| | | 25° C. | 37° C. | 25° C. | 37° C. | 25° C. | 37° C. |
| mAb2.0 | hu-IL-36α | 1.2 | 0.3 | 3.45*10$^5$ | 1.69*10$^6$ | 4.13*10$^{-4}$ | 5.02*10$^{-4}$ |
| mAb6.0 | hu-IL-36β | 1.79 | 1.93 | 4.04*10$^4$ | 6.11*10$^4$ | 7.23*10$^{-5}$ | 1.18*10$^{-4}$ |
| mAb2.0 | hu-IL-36γ | 0.98 | 1.61 | 3.66*10$^5$ | 6.71*10$^5$ | 3.58*10$^{-4}$ | 1.08*10$^{-3}$ |

E. Functional Activity of Recombinant Anti-IL-36 Antibodies in Cell-Based Assays hu-IL-36-Blocking Activity of Antibodies in HEK Blue Reporter Assay The recombinant anti-hu-IL-36 antibodies derived from the eight parental yeast clones, mAb1.0-mAb8.0, were tested to determine their abilities to block hu-IL-36α, hu-IL-36β and hu-IL-36γ mediated activation of the IL1RL2/IL1

RAP pathways using the HEK-Blue IL-1/AL-33 sensor cells transiently transfected with the IL-36 receptor, IL1RL2.

HEK-Blue SEAP assays using recombinant anti-hu-IL-36 antibodies were performed similarly to the assay described above with yeast cell culture SN. Briefly, the antibody was incubated with cells, in the absence of agonist within the standard growth medium, for one hour at 37° C. with 5% $CO_2$. Following the one-hour incubation, the desired agonist, at the estimated $EC_{50}$ concentration, was added to a final volume 200 µL and the experiment was allowed to proceed for an additional 24 hours. The negative control (NC), represents cells exposed to growth medium only, while the positive control (PC) represents cells exposed to the agonist only (in the absence of antagonistic or control antibodies).

To determine the half maximal inhibitory concentration ($IC_{50}$) of the antibodies (including Fabs as described in the following Examples), a seven-point serial dilution series was used (starting at the concentration indicated). As with the agonist dose response curves described herein, non-linear regression analysis was performed using GraphPad Prism 7 software to determine the $IC_{50}$ value from the assay results.

Hu-IL-36α (SEQ ID NO: 1), hu-IL-36β (SEQ ID NO: 2), and hu-IL-36γ (SEQ ID NO: 3), were used as agonists in the following HEK-Blue assays. Dose responses were carried out for all of the mAbs. Results of these HEK Blue assays are shown below in Table 6.

TABLE 6

IL-36 inhibition in HEK Blue assay of recombinant anti-hu-IL-36 antibodies

| Antibody | $IC_{50}$ (nM) | | |
|---|---|---|---|
| | hu-IL-36α | hu-IL-36β | hu-IL-36γ |
| mAb1.0 | 43 | N.D. | 5.3 |
| mAb2.0 | 5.7 | N.D. | 7.5 |
| mAb3.0 | 90 | N.D. | 30 |
| mAb4.0 | 16 | N.D. | 52 |
| mAb5.0 | 95 | N.D. | 142 |
| mAb6.0 | N.D. | 0.64 | N.D. |
| mAb7.0 | N.D. | 1.4 | N.D. |
| mAb8.0 | N.D. | 0.34 | N.D. |

N.D. = no blocking activity detected

As shown by the HEK Blue assay results of Table 6, of all antibodies tested mAb2.0 demonstrated the most potent blocking activity for both hu-IL-36α and hu-IL-36γ, whereas mAb6.0 demonstrated potent blocking activity for hu-IL-36β.

Cy-IL-36-Blocking Activity of Antibodies in HEK Blue Reporter Assay

The recombinant anti-hu-IL-36 antibodies mAb2.0 and mAb6.0 were tested to determine their abilities to block cynomolgus monkey IL-36 (cy-IL-36α, cy-IL-36β and cy-IL-36γ)-mediated activation of the IL1RL2/IL1RAP pathways using the HEK-Blue IL-1/IL-33 sensor cells transiently transfected with the human IL-36 receptor IL1 RL2. HEK-Blue SEAP assays performed using cynomolgus monkey IL-36 were performed similarly to the assay described above with human IL-36 cytokines. Cy-IL-36α, cy-IL-36β, and cy-IL-36γ, were used as agonists in this HEK-Blue assay. Agonist dose-response curves, consisting of a twelve-point serial dilution series, were generated to demonstrate potent signaling of the cy-IL-36 cytokines through the human IL1 RL2/IL1RAP pathways, and to provide an estimate of the half maximal effective concentration ($EC_{50}$) of agonist to be used in the assay. To determine the half maximal inhibitory concentration ($IC_{50}$) of the antibodies an eleven-point serial dilution series was used. As with the agonist dose response curves mentioned previously, non-linear regression analysis was performed using GraphPad Prism 7 software to determine the $IC_{50}$ value from the assay results. Dose responses were carried out for all of the mAbs. mAb2.0 demonstrated potent blocking activity for cy-IL-36α and cy-IL-36γ ($IC_{50}$ 0.56 nM and 1.71 nM, respectively), whereas mAb6.0 demonstrated potent blocking activity for cy-IL-36β ($IC_{50}$ 1.96 nM).

Blocking Activity of Anti-Hu-IL-36 Antibodies in IL-36-Stimulated IL-8 Secretion by HaCat Cells The human keratinocyte cell line HaCat is derived from in vitro spontaneously transformed keratinocytes from histologically normal skin. The HaCat cell line is commercially available and was obtained from AddexBio (catalog #T002000). The cryopreserved cells were thawed and maintained using the general guidelines recommended by the manufacturer. HaCat cells were maintained in a growth medium consisting of DMEM with L-Glutamine, 4.5 g/L Glucose and Sodium Pyruvate (Corning), supplemented with 10% fetal bovine serum (Atlanta Biologicals) that was heat-inactivated prior to use (56° C. for 30 minutes), 100 IU/mL penicillin and 100 µg/mL streptomycin, 1 mM sodium pyruvate (Corning). The day prior to experimental use, HaCat cells were seeded on flat-bottom, 96-well plates at 10,000 cells/well to be at ~80-85% confluency the day of use.

Prior to use in antibody blocking assays, the agonist $EC_{50}$ was determined by performing an agonist dose-response curve in a similar manner as described in Example 2 for the HEK Blue cells but with the following modifications. Following addition of the agonist to HaCat cells in wells containing HaCat cell growth medium only (final volume 200 µL), the cells were returned to the tissue culture incubator (37° C. with 5% $CO_2$) for 24 hours. Tissue culture supernatant was then collected and stored at −20° C.

The antibody blocking assays were performed as above for HEK Blue cells but in a manner conducive to obtaining $IC_{50}$ values, with modifications to specifically account for HaCat cell usage. Briefly, the anti-hu-IL-36 IgG antibody, the natural IL-36 antagonist IL-36Ra, or an appropriate antibody control (e.g., Hu IgG1 Ctrl), was incubated with HaCat cells for 1 hour at 37° C., followed by the addition of agonist (IL-36α, IL-36β, or IL-36γ). The experiment was allowed to proceed for an additional 24 hours (37° C. with 5% $CO_2$), with cell culture supernatants collected and quantification of IL-8 performed as described below.

A human IL-8 ELISA kit (Thermo Fisher Scientific) was used to quantify the level of IL-8 within the supernatant according to the manufacturer guidelines. The raw data obtained was analyzed using GraphPad Prism software, with interpolations performed using linear regression analysis. Interpolated data was then analyzed using non-linear regression 3 parameter analysis to derive agonist $EC_{50}$ and antibody $IC_{50}$ values.

Figure 1B:
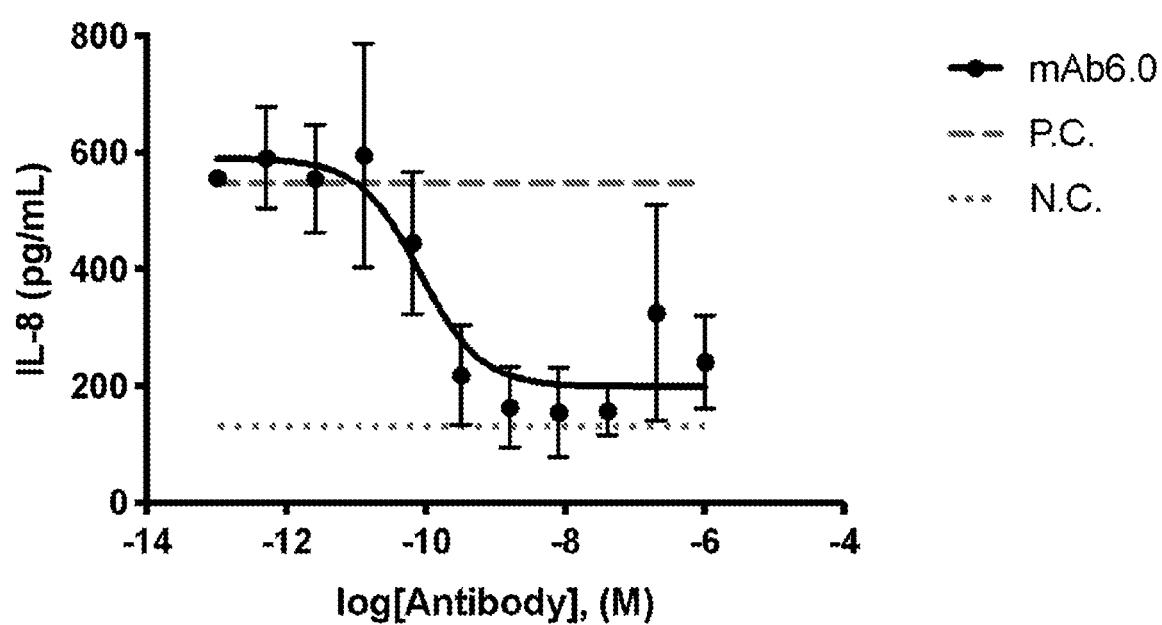
Figure 1C:
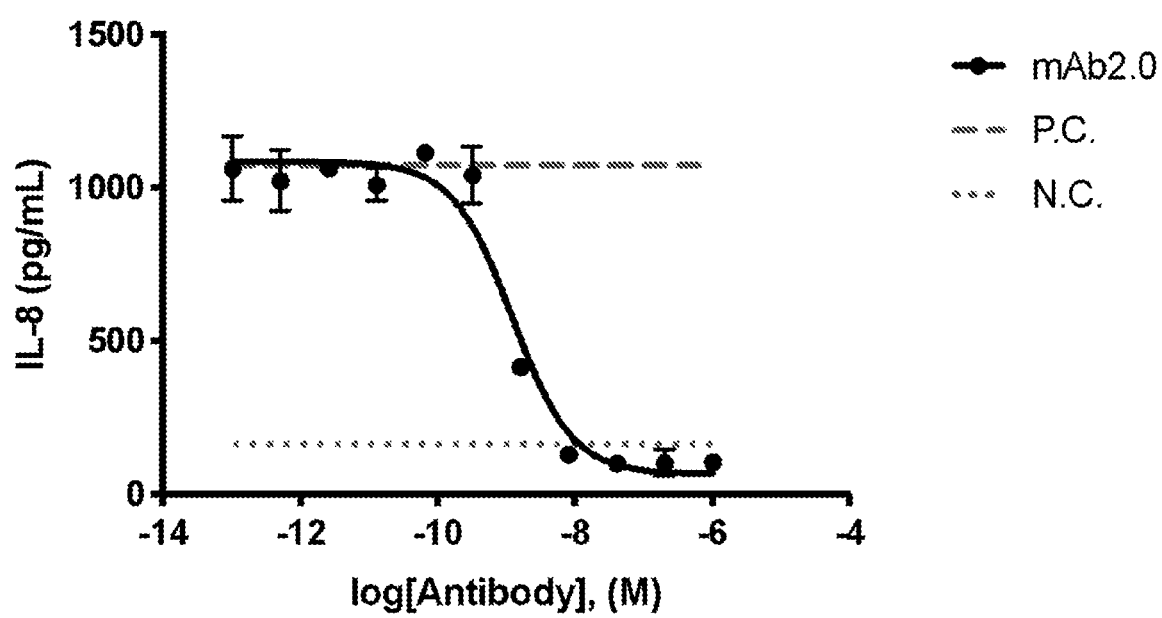

As shown by the results in FIG. 1A and FIG. 1C, mAb2.0 demonstrated potent blocking activity for hu-IL-36α and hu-IL-36γ ($IC_{50}$ 0.28 nM and 1.23 nM, respectively), whereas as shown in FIG. 1B, mAb6.0 demonstrated potent blocking activity for hu-IL-36β ($IC_{50}$ 0.082 nM) in the HaCat human keratinocyte cell line. The blocking potency of mAb2.0 for hu-IL-36α and hu-IL-36γ was superior to that of the natural antagonist IL-36Ra (100-fold and 12-fold, respectively), and the blocking potency of mAb6.0 for hu-IL-36β was superior to that of IL-36Ra (1000-fold).

Activity of Anti-IL-36 Antibodies in Blocking IL-36-Stimulated IL-8 Secretion by Primary Human Keratinocytes Primary human neonatal pooled keratinocytes (HEKn) are commercially available and were obtained from ThermoFisher (catalog #A13401). Cells were isolated from normal (disease free) donated human tissue and cryopreserved by the manufacturer. The cells were thawed and maintained using the general guidelines recommended by the manufacturer. HEKn cells were maintained in a growth medium consisting of EpiLife Medium (ThermoFisher) with Human Keratinocyte Growth Supplement (ThermoFisher), 100 IU/mL penicillin and 100 µg/mL streptomycin. The day prior to experimental use, HEKn cells were seeded on flat-bottom, 96-well plates at 10,000 cells/well to be at ~80-85% confluency the day of use.

Prior to use in antibody blocking assays, the agonist $EC_{50}$ was determined by performing an agonist dose-response curve in a similar manner as described in Example 2 for the HaCat cells but with the following modifications. Following addition of the agonist to HEKn cells in wells containing cell growth medium only (final volume 200 µL), the cells were returned to the tissue culture incubator (37° C. with 5% $CO_2$) for 24 hours. Tissue culture supernatant was then collected and stored at −20° C.

The antibody blocking assays were performed as above for HaCat cells. Briefly, xIL-36 IgG, or an appropriate antibody control (e.g., Hu IgG1 Ctrl), was incubated with HEKn cells, as indicated, for 1 hour at 37° C., followed by the addition of agonist (IL-36α, IL-36β, or IL-36γ). The experiment was allowed to proceed for an additional 24 hours (37° C. with 5% $CO_2$), with cell culture supernatants collected and quantification of IL-8 performed as described below.

A human IL-8 ELISA kit (Thermo Fisher Scientific) was used to quantify the level of IL-8 within the supernatant according to the manufacturer guidelines. The raw data obtained was analyzed using GraphPad Prism software, with interpolations performed using linear regression analysis. Interpolated data was then analyzed using standard non-linear regression 3 parameter analysis to derive agonist $EC_{50}$ and antibody $IC_{50}$ values.

Figure 2A:
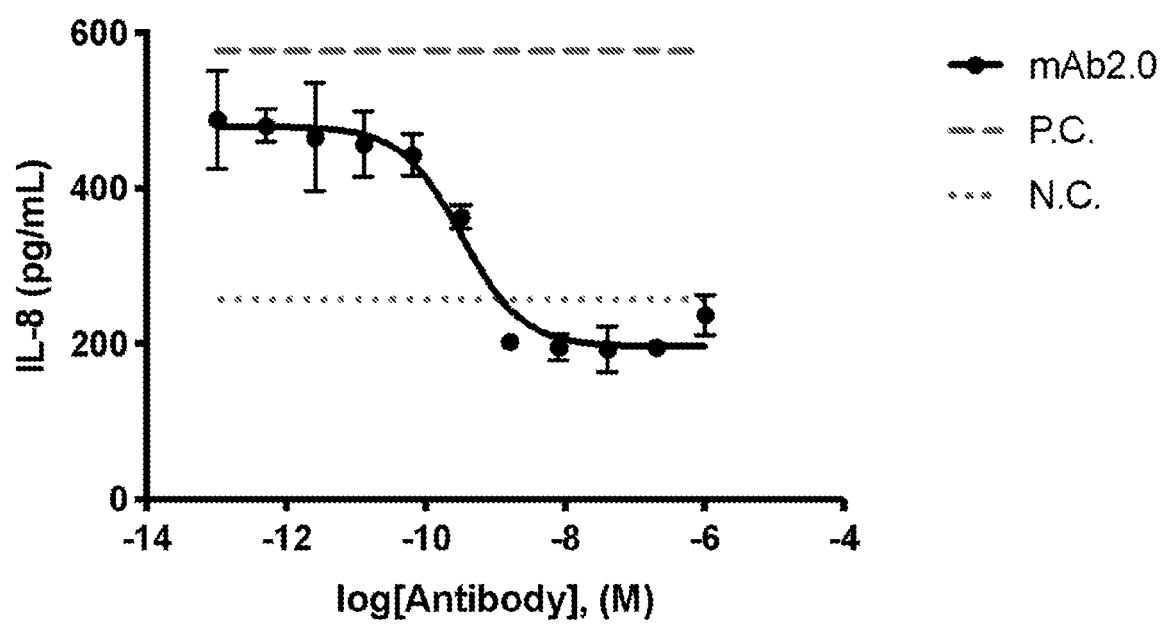
FIG. 2A, FIG. 2B, and FIG. 2C depict plots of results for the yeast display-derived anti-hu-IL-36 antibodies mAb2.0 and mAb6.0 in inhibition assays of IL-36-stimulated intracellular signaling in primary human neonatal pooled keratinocytes (HEKn).
Figure 2B:
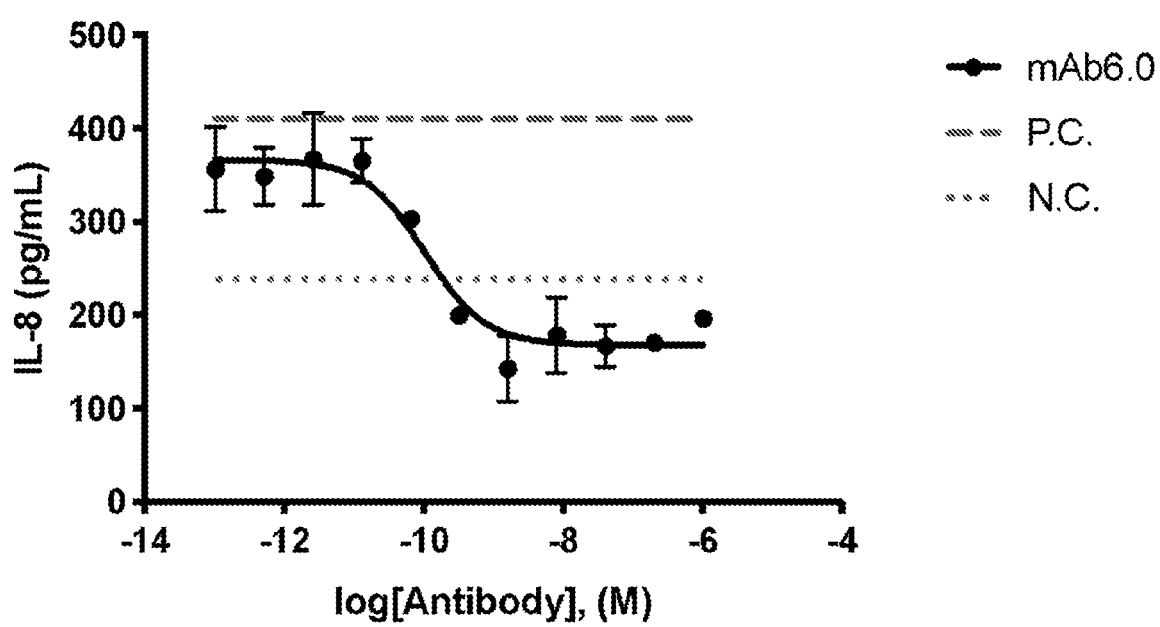
Figure 2C:
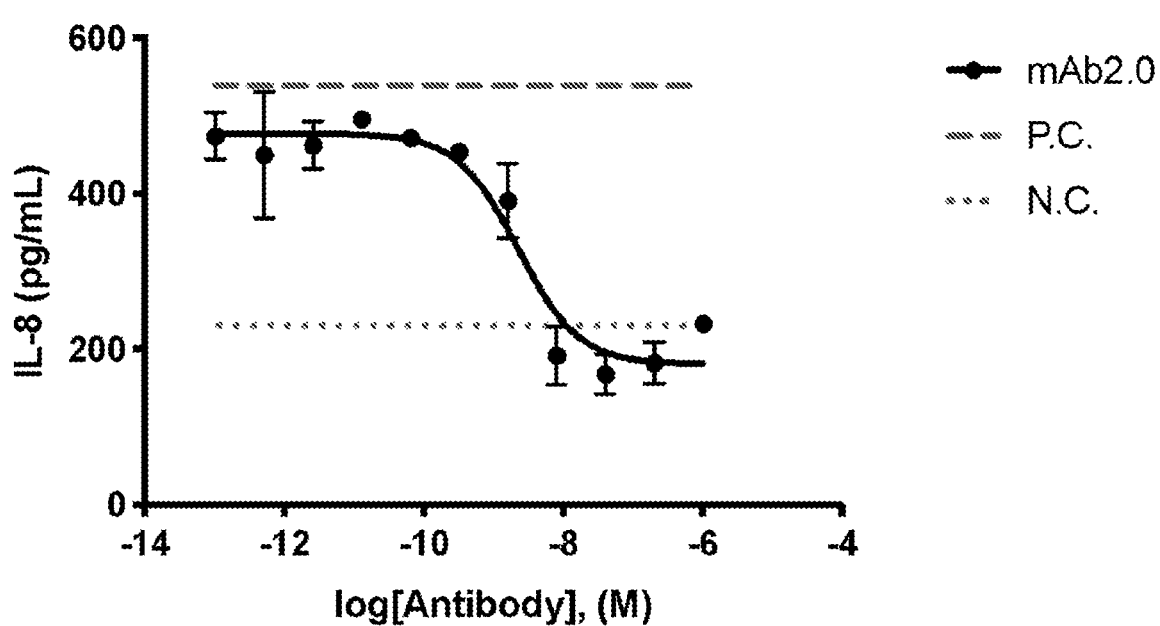

As shown by the HEKn assay results in FIG. 2A and FIG. 2C, mAb2.0 demonstrated potent blocking activity for hu-IL-36α and hu-IL-36γ ($IC_{50}$ 0.33 nM and 2.27 nM, respectively), whereas as shown in FIG. 2B, mAb6.0 demonstrated potent blocking activity for hu-IL-36β ($IC_{50}$ 1.75 nM) in primary human adult keratinocytes.

Example 3: Activity of mAb6.0 HC/mAb2.0 LC Chimera mAb6.0_2.0 in Binding and Blocking hu-IL-36β mAb6.0_2.0 was generated similar to other IgGs described in Example 2 above, except by co-transfecting the heavy chain of mAb6.0 and the light chain of mAb2.0.

Surface plasmon resonance (SPR) analysis was used to determine binding affinity for hu-IL-36β of mAb6.0_2.0 IgG using a BIACORET™ 8K instrument (GE Healthcare, Chicago, IL, USA). Briefly, 6 nM mAb6.0_2.0 IgG or mAb6.0 IgG in HBS-P buffer (GE Healthcare, Chicago, IL, USA; 0.01 M HEPES pH 7.4, 0.15 M NaCl, 0.005% surfactant P20) was captured on a protein A sensor chip (GE Healthcare, Chicago, IL, USA) a 10 µL/min to achieve 50-60 response units in the second flow cell (FC2). FC1 was kept as a reference. Next, 3-fold serial dilutions of hu-IL-36β in HBS-P buffer from low (0.046 nM of hu-IL-36β) to high (100 nM of hu-IL-36β) were injected (flow rate: 30 µL/min) at either 37° C. The sensorgram was recorded and subject to reference and buffer subtraction before data analysis with the BIACORE® 8K Evaluation Software (GE Healthcare, Chicago, IL, USA; version 1.1.1.7442). Association rates ($k_{on}$) and dissociation rates ($k_{off}$) were calculated using a simple one-to-one Langmuir binding model. The equilibrium dissociation constant ($K_D$) was calculated as the ratio of $k_{off}/k_{on}$.

mAb6.0_2.0 IgG bound hu-IL-36β with a $K_D$ of 6.7 nM ($k_{on}$=3.20×10$^5$ 1/Ms, $k_{off}$=2.14×10$^{-3}$ 1/s) while mAb6.0 IgG bound hu-IL-36β with a $K_D$ of 0.42 nM ($k_{on}$=3.62×10$^5$ 1/Ms, $k_{off}$=1.15×10$^{-4}$ 1/s). Thus mAb6.0_2.0 bound hu-IL-36β with a 16-fold lower affinity than mAb6.0.

To determine the blocking potency and efficacy of mAb6.0_2.0 IgG in vitro, we evaluated its ability to inhibit hu-IL-36β-stimulated IL-8 secretion by HaCat cells. HaCat cell assays were performed as described in Example 2. Briefly, mAb6.0_2.0 IgG, mAb6.0 IgG, or an appropriate antibody control (e.g., Hu IgG1 Ctrl), was incubated with HaCat cells for 1 hour at 37° C., followed by the addition of hu-IL-36β agonist. The experiment was allowed to proceed for an additional 24 hours (37° C. with 5% $CO_2$), with cell culture supernatants collected and quantification of IL-8 performed as described in Example 2. Interpolated data was then analyzed using standard non-linear regression analysis in GraphPad Prism software to derive antibody $IC_{50}$ values.

mAb6.0_2.0 IgG was found to inhibit hu-IL-36β-stimulated IL-8 secretion by HaCat keratinocyte cell line with a 16-fold lower potency than mAb6.0 IgG (mAb6.0_2.0 $IC_{50}$=12.7 nM; mAb6.0 $IC_{50}$=0.8 nM).

Example 4: Affinity Maturation of Anti-IL-36 Antibodies Using Phage Library Panning This example illustrates the preparation of affinity matured versions of the mAb6.0_2.0 and mAb2.0 antibodies with improved affinities for IL-36β and IL-36α/γ.

A Mutation to Prevent Pyrogkitamate Conversion

To prevent the formation of pyroglutamate variants, glutamine (Q or Gln) may be mutated to glutamate (E or Glu) (Amphlett, G. et al., Pharm. Biotechnol., 9:1-140 (1996)). Position 1 (according to Kabat numbering) in the heavy chain variable domains and light chain variable domains of mAb2.0 and mAb6.0 was mutated from glutamine (Q) to glutamate (E) by gene synthesis, resulting in antibodies mAb2, mAb6 and mAb6_2. The variable domains were cloned into a mammalian Fab expression construct containing an 8×His tag to generate Fab proteins. Similar mutations at position 1 may also be made in mAb1.0, mAb3.0, mAb4.0, mAb5.0, mAb7.0 and mAb8.0.

B. mAb6_2 Affinity Maturation NNK Library Construction and Panning

To improve the affinity of mAb6 heavy chain paired with mAb2 light chain (mAb6_2, one arm for common light chain bispecific molecule) against human IL-36β, phage libraries were constructed from mAb6_2 in Fab-amber format for monovalent Fab phage display with heavy chain HVR residues (i.e., HVR-H1, HVR-H2, and HVR-H3) randomized using the NNK degenerate codon that encodes for all 20 amino acids with 32 codons (Brenner et al., 1992) (with mAb2 light chain residues kept unchanged). Libraries were designed to allow one NNK mutation in each of the three heavy chain HVRs. Synthesized mutagenesis oligonucleotides were then used to construct heavy chain libraries using Kunkel mutagenesis (Kunkel et al., 1987). The resultant library DNA was electroporated into *E. coli* XL1 cells, yielding approximately 4×10$^9$ transformants. Phage libraries were incubated in SUPERBLOCKT™ PBS buffer (Pierce) and 0.05% TWEEN® 20 for 30 min and then applied on human IL-36β coated plate for first round panning. In the subsequent two to three rounds, phage libraries were incubated with decreasing concentration of biotinylated human IL-36β with 1000× non-biotinylated human IL-36β as competitor in solution to increase the selection stringency.

C. Characterization of mAb6_2 Phage Variants from Affinity Maturation NNK Library Selected phages with top binding signal were purified to perform phage competition ELISA. The optimal phage concentration was incubated with serially-diluted human IL-36β in ELISA buffer (0.5% BSA and 0.05% TWEEN®20 in PBS) in NUNC F plate for two hours. 80 μl of the mixture was transferred to human IL-36β coated wells for 15 min to capture unbound phage. The plate was washed with wash buffer (0.05% TWEEN®20 in PBS), and HRP-conjugated anti-M13 antibody (Sino biological, Cat #11973-MM05-H-50) was added in ELISA buffer for 30 min. The plate was incubated at room temperature for one hour with agitation, washed six times with wash buffer and developed for 15 minutes by addition of 100 μL/well of 1 Step Turbo TMB substrate (ThermoFisher, Cat #34022). The enzymatic reaction was stopped using 50 μL/well of 2N $H_2SO_4$. Plates were analyzed using a Perkin Elmer plate reader (Envision 2103 multilabel reader) at 450 nm. The absorbance at 450 nm was plotted as a function of antigen concentration in solution to determine phage $IC_{50}$. This was used as an affinity estimate for the Fab clone displayed on the surface of the phage. Real affinities for purified Fab molecules for the phage variants were also measured using Biacore (method described in detail in section E below). Variant HVR sequences, phage $IC_{50}$ summary and $K_D$ values are shown below in Table 7.

TABLE 7 mAb6_2 variant HVR sequences, $IC_{50}$ and $K_D$ values against hu-IL-36β

| Variant | HVR-H1 (30-35A) | HVR-H2 (50-61) | HVR-H3 (93-102) | $IC_{50}$ (nM) | Biacore $K_D$ (nM) |
|---|---|---|---|---|---|
| mAb6_2 | TSSNYYW (SEQ ID NO: 66) | SIDYTG STYYNP (SEQ ID NO: 67) | ARGKYYETY LGFDV (SEQ ID NO: 68) | 8.57 | 40.1 |
| mAb6_2.1 | TSTNYYW (SEQ ID NO: 82) | NIDYTG STYYNA (SEQ ID NO: 83) | ATGKYYETY LGFDV (SEQ ID NO: 84) | 0.77 | 3.50 |
| mAb6_2.2 | TSSNAYW (SEQ ID NO: 86) | SIDYTG STAYNP (SEQ ID NO: 87) | AHGKYYETY LGFDV (SEQ ID NO: 88) | 1.04 | 2.55 |
| mAb6_2.3 | TASNYYW (SEQ ID NO: 90) | SIDYTG STYYNT (SEQ ID NO: 91) | ATGKYYETY LGFDV (SEQ ID NO: 84) | 0.49 | 1.62 |
| mAb6_2.4 | TASNYYW (SEQ ID NO: 90) | SIDYTG STYYNP (SEQ ID NO: 67) | ATGKYYETY LGFDV (SEQ ID NO: 84) | ND | 1.05 |

D. Next Generation Sequencing of mAb6_2 Affinity Maturation Libraries

In order to further improve the affinity of mAb6_2, next-generation sequencing (NGS) of mAb6_2 affinity maturation libraries was performed. Phagemid double-stranded DNA was isolated from *E. coli* XL-1 cells carrying phagemids from the initial phage library (unsorted libraries) and from the second and third rounds of solution selection (sorted libraries). Purified DNA was used as the template to generate amplicons of $V_H$ regions using the Illumina 16s library preparation protocol. Sequencing adapters and dual-index barcodes were added using the Illumina Nextera XT Index Kit. In preparation for sequencing on an Illumina MiSeq instrument (Illumina, San Diego, USA), adapter-ligated amplicons were subjected to standard Illumina library denaturing and sample loading protocol using MiSeq Reagent Kit v3 (600 cycles). Paired-end sequencing was performed to cover the entire length of the amplicon with insert size of 200 bp to 300 bp.

Paired-end sequencing data were first assembled using paired-end assembler PANDAseq (Masella et al., 2012) to obtain complete amplicons. Quality control (QC) was then performed on identified amplicons, where each amplicon was checked for the absence of sequence insertions or deletions and stop codons, and each CDR sequence was allowed to carry only up to one NNK mutation and no non-NNK mutations. Position weight matrices were generated by calculating the frequency of all mutations of every randomized position. Enrichment ratios for each mutation were calculated by dividing the frequency of a given mutation at a given position in the sorted sample with the frequency of the very same mutation in the unsorted sample, as described previously (Koenig et al., 2015). Predicted mutations in their HVRs that supported improved binding of mAb6_2 to hu-IL-36β are summarized in Table 8 below.

TABLE 8

Predicted mutations in mAb6_2 supporting hu-IL-36β binding

| Domain | Position | Substitutions with Improved Binding |
|---|---|---|
| HVR-H1[1] | T30 | D, E, N |
| | S31 | A, E, G, K, Q, R, T |
| | S32 | A, D, E, G, N, P, Q, T |
| | Y34 | A, E, G, H, M, N, Q, S, T, V |
| | W35A | F, I, V, Y |
| HVR-H2[2] | S50 | N, T |
| | I51 | M, V |
| | Y53 | H |
| | T54 | H, L, N |
| | G55 | A, D, E, H, K, N, Q, R, S, T |
| | S56 | A, D, Q, T |
| | T57 | A, D, E |
| | Y58 | A, F, Q, S, W |
| | N60 | D, E, H, P, Q |
| | P61 | A, E |
| HVR-H3[3] | R94 | A, E, G, H, M, N, Q, S, T, Y |
| | K96 | A, S |
| | E99 | T |

[1]HVR-H1 from positions 30-35A
[2]HVR-H2 from positions 50-61
[3]HVR-H3 from positions 93-102

E. Characterization of mAb6_2 Affinity-Improved NGS Variants

Generation of mAb6_2 Affinity-Improved NGS Fab Variants

According to predicted mutations from NGS analysis (shown in Table 8 above), selected mAb6_2 NGS Fabs with variant HVR sequences (shown below in Table 9) were synthesized for cloning into a mammalian Fab expression construct containing an 8×His tag to generate Fab proteins. Plasmids encoding the heavy or light chain were transiently transfected into Expi293F cells (Thermo Fisher) according to the manufacturer's protocol using a 1:1 ratio of HC:LC.

Fabs were purified with a HisPur Ni-NTA column by diluting supernatant 1.5× with 1× phosphate-buffered saline pH 7.2 (PBS), adding 10 mM imidazole, and binding to resin in batch mode for 2 hours. Resin was flowed over a column and washed with 20 CV PBS+20 mM imidazole and eluted with 5 CV PBS+250 mM imidazole. Samples were buffer exchanged to PBS using a PD10 column (GE).

Affinity Determination of mAb6_2 Affinity-Improved NGS Fab Variants Using SPR

To determine the binding affinity of recombinant mAb6.2 NGS Fab variants to human IL-36β at 37° C., SPR measurements with a BIACORE™ 8K instrument were performed. Briefly, a 1:4 dilution of Biotin CAPture Reagent (GE) into HBS-EP buffer (0.01 M HEPES pH 7.4, 0.15 M NaCl, 3 mM EDTA, 0.005% Surfactant P20) was applied to a CAP sensor chip at 2 uL/min flow rate. For kinetics measurements, 6 nM biotinylated human IL-36β was captured at 10 uL/min to achieve ~50 response units in the second flow cell (FC2). FC1 was kept as a reference. Next, 3-old serial dilutions of Fab in HBS-P buffer (0.1 M HEPES pH 7.4, 0.15 M NaCl, 0.005% surfactant P20) from low (3.125 nM) to high (200 nM) were injected (flow rate: 10 uL/min) at 37° C. The sensorgram was recorded and subject to reference and buffer subtraction before evaluating by BIACORE® Evaluation Software (version 1.1.1.7442). Association rates ($k_{on}$) and dissociation rates ($k_{off}$) were calculated using a simple one-to-one Langmuir binding model. The equilibrium dissociation constant ($K_D$) was calculated as the ratio of $k_{off}/k_{on}$ summarized in Table 9.

F. mAb2 Affinity Maturation NNK Library Construction and Panning

To further improve the human IL-36α and human IL-36γ affinity of anti-IL-36 mAb2, phage libraries were constructed from mAb2 in Fab-amber format for monovalent Fab phage display with heavy chain HVR residues (i.e., HVR-H1, HVR-H2, and HVR-H3) randomized using the NNK degenerate codon that encodes for all 20 amino acids with 32 codons (Brenner et al., 1992) (with mAb2 light chain residues kept unchanged). Libraries were designed to allow one NNK mutation in each of the three heavy chain HVRs. Synthesized mutagenesis oligonucleotides were then used to construct heavy chain libraries using Kunkel mutagenesis (Kunkel et al., 1987). The resultant library DNA was electroporated into *E. coli* XL1 cells, yielding approximately 4×10$^9$ transformants. Phage libraries were incubated in SUPERBLOCKT™ PBS buffer (Pierce) and 0.05% TWEEN® 20 for 30 min and then applied on human IL-36α or human IL-36γ coated plates for first round panning. In the subsequent two to three rounds, phage libraries were incubated with decreasing concentrations of biotinylated human IL-36α or human IL-36γ with 1000× non-biotinylated human IL-36α or human IL-36γ as competitor in solution to increase the selection stringency.

G. Characterization of mAb2 Phage Variants from Affinity Maturation NNK Library

Selected phages with top binding signal were purified to perform phage competition ELISA. The optimal phage concentration was incubated with serially-diluted human IL-36α or human IL-36γ in ELISA buffer in NUNC F plate

TABLE 9 mAb6_2 variant HVR sequences, their $k_{on}$, $k_{off}$ and $K_D$ values against hu-IL-36β

| Fab Identifier | HVR-H1 (30-35A) | HVR-H2 (50-61) | HVR-H3 (93-102) | $k_{on}$(1/MS) | $k_{off}$(1/S) | $K_D$ (nM) |
|---|---|---|---|---|---|---|
| mAb6_2 | TSSNYYW (SEQ ID NO: 66) | SIDYTG STYYNP (SEQ ID NO: 67) | ARGKYYE TYLGFDV (SEQ ID NO: 68) | 8.72 × 10$^4$ | 1.28 × 10$^{-3}$ | 14.7 |
| mAb6_2.5 | TASNYYW (SEQ ID NO: 90) | SIDYTG STYYEP (SEQ ID NO: 99) | ATGSYYE TYLGFDV (SEQ ID NO: 100) | 7.17 × 10$^5$ | 4.76 × 10$^{-4}$ | 0.66 |
| mAb6_2.6 | TASNYYW (SEQ ID NO: 90) | SIDYTG STYYEP (SEQ ID NO: 99) | ATGNYYE TYLGFDV (SEQ ID NO: 104) | 8.50 × 10$^5$ | 7.05 × 10$^{-4}$ | 0.82 |
| mAb6_2.7 | TASNTYW (SEQ ID NO: 106) | SIDYTG STYYNP (SEQ ID NO: 67) | ATGKYYE TYLGFDV (SEQ ID NO: 84) | 2.97 × 10$^5$ | 1.80 × 10$^{-4}$ | 0.61 |
| mAb6_2.8 | TASNYYW (SEQ ID NO: 90) | SIDYTG STYYNP (SEQ ID NO: 67) | ASGKYYE TYLGFDV (SEQ ID NO: 112) | 3.17 × 10$^5$ | 3.43 × 10$^{-4}$ | 1.08 |
| mAb6_2.9 | TSSNYYW (SEQ ID NO: 66) | SIDYTG STYYNP (SEQ ID NO: 67) | ATGKYYE TYLGFDV (SEQ ID NO: 84) | 2.99 × 10$^5$ | 4.11 × 10$^{-4}$ | 1.37 |
| mAb6_2.10 | TSSNYYW (SEQ ID NO: 66) | SIDYTG STYYQP (SEQ ID NO: 119) | ARGNYYE TYLGFDV (SEQ ID NO: 120) | 4.15 × 10$^5$ | 1.03 × 10$^{-3}$ | 2.47 | for two hours. 80 µl of the mixture was transferred to human IL-36α or human IL-36γ coated wells for 15 min to capture unbound phage. The plate was washed with wash buffer (0.05% TWEEN®20 in PBS), and HRP-conjugated anti-M13 antibody (Sino biological, Cat #11973-MM05-H-50) was added in ELISA buffer for 30 min. The plates were washed and developed as described above. The absorbance at 450 nm was plotted as a function of antigen concentration in solution to determine phage IC50. This was used as an affinity estimate for the Fab clone displayed on the surface of the phage. See Table 10 below for a summary of variant HVR sequences and phage $IC_{50}$.

obtain complete amplicons. Quality control (QC) was then performed on identified amplicons, where each amplicon was checked for no insertion or deletion of sequences and no stop codons, each CDR sequence was allowed to carry only up to one NNK mutation and no non-NNK mutation. Position weight matrices were generated by calculating the frequency of all mutations of every randomized position. Enrichment ratios for each mutation were calculated by dividing the frequency of a given mutation at a given position in the sorted sample with the frequency of the very same mutation in the unsorted sample, as described previously (Koenig et al., 2015). The predicted mutations in the

TABLE 10 mAb2 HVR sequences and their $IC_{50}$ values against hu-IL-36α and hu-IL-36γ.

| Variant | HVR-H1 (30-35A) | HVR-H2 (50-61) | HVR-H3 (93-102) | Phage $IC_{50}$ (nM) hu-IL-36α | Phage $IC_{50}$ (nM) hu-IL-36γ |
|---|---|---|---|---|---|
| mAb2 | STSSYYW (SEQ ID NO: 50) | SIYYTGNTYYNP (SEQ ID NO: 51) | ARVRYGVGVPRYFDP (SEQ ID NO: 52) | 1.20 | 3.20 |
| mAb2.1 | SDSSYYW (SEQ ID NO: 122) | SIYYTGNTYYNS (SEQ ID NO: 123) | ARVRYGVGVPRYFDP (SEQ ID NO: 52) | 1.03 | 4.86 |
| mAb2.2 | SESSYYW (SEQ ID NO: 126) | SIYYTGNTYYNP (SEQ ID NO: 51) | AGVRYGVGVPRYFDP (SEQ ID NO: 128) | 0.75 | 3.79 |
| mAb2.3 | STSSDYW (SEQ ID NO: 130) | SIYYTGNTYYLP (SEQ ID NO: 131) | SRVRYGVGVPRYFDP (SEQ ID NO: 132) | 0.82 | 2.39 |
| mAb2.4 | SNSSYYW (SEQ ID NO: 134) | SIYYTGNTYYLP (SEQ ID NO: 131) | ARVRYGVGVPRYFDP (SEQ ID NO: 52) | 0.68 | 1.52 |
| mAb2.5 | SESSYYW (SEQ ID NO: 126) | SIYYTGNTYYLP (SEQ ID NO: 131) | ARVRYGVGVPRYFDP (SEQ ID NO: 52) | 0.77 | 1.88 |
| mAb2.6 | STSSYHW (SEQ ID NO: 142) | SIYYTGNTYYMP (SEQ ID NO: 143) | VRVRYGVGVPRYFDP (SEQ ID NO: 144) | 1.62 | 1.99 |
| mAb2.7 | SRSSYYW (SEQ ID NO: 146) | SIYYTGNTYYWP (SEQ ID NO: 147) | TRVRYGVGVPRYFDP (SEQ ID NO: 148) | 1.20 | 1.53 |

H. Next-Generation Sequencing of mAb2 Affinity Maturation Libraries

In order to further improve the affinity of mAb2, next-generation sequencing (NGS) of mAb2 affinity maturation libraries was performed. Phagemid double-stranded DNA was isolated from *E. coli* XL-1 cells carrying phagemids from the initial phage library (unsorted libraries) and TABLE 11-continued Predicted mutations in mAb2 supporting human IL-36α and IL-36γ binding

| Domain | Position | Substitutions with Improved Binding |
|---|---|---|
| HVR-H3[3] | N56 | D, E, G, H, I, K, M, P, R, S |
| | T57 | A, E, F, G, H, K, P, Q, R, S, V, W, Y |

TABLE 14-continued

Blocking activity of affinity-matured anti-IL-36 antibody
variants in IL-36-stimulated IL-8 secretion by HaCat cells

| | $IC_{50}$ (nM) | | |
|---|---|---|---|
| Recombinant mAb | IL-36α | IL-36β | IL-36γ |
| mAb6_2 Fab | N.T | 3.19 | N.T |
| mAb6_2.1 Fab | N.T | 1.64 | N.T |
| mAb6_2.2 Fab | N.T | 2.22 | N.T |
| mAb6_2.3 Fab | N.T | 1.31 | N.T |
| mAb6_2.4 Fab | N.T | 0.13 | N.T |
| mAb6_2.5 Fab | N.T | 0.2 | N.T |
| mAb6_2.7 Fab | N.T | 0.2 | N.T |
| mAb6_2.8 Fab | N.T | 0.33 | N.T |

As shown in Table 14, mAb2.10 Fab demonstrated the most potent blocking activity of hu-IL-36α- and hu-IL-36γ-mediated IL-8 production in HaCat cells, with an $IC_{50}$ of approximately 0.38 nM and 1.09 nM, respectively. As further shown in Table 14, mAb6_2.7 Fab demonstrated improved blocking activity of IL-36β-mediated IL-8 production in HaCat cells, with an $IC_{50}$ of approximately 0.2 nM.

Example 6: Generation of Anti-IL-36 Multispecific Antibody mAb2.10/mAb6_2.7 mAb2.10 and mAb6_2.7 heavy chains were cloned in a "knobs-into-holes" format (Ridgway et al, 1996) into pRK expression vector in a two-step cloning process. In step 1, mAb2.10 was synthesized and cloned into a pRK vector (using AgeI and BstEII) already containing hole mutations (T366S, L368A and Y407V) and a 8×His tag. mAb6_2.7 was synthesized and cloned into a pRK vector (using AgeI and BstEII) already containing knob mutation (T366W) and a Flag tag. mAb2 light chain was also cloned in pRK expression vector with no extra mutations. After a successful initial test of expression and purification of multispecific antibody with tagged constructs, in step 2 of the cloning process, tags were removed from mAb2.10 and mAb6_2.7 heavy chains. 8×His tag from mAb2.10 was completely removed using a set of primers (Forward Primer: 5'Phos-TAAGCTTGGCCGCCATGGCC-3' (SEQ ID NO: 514) and Reverse Primer: 5'Phos-ACCCGGAGACAGG-GAGAGGC-3' (SEQ ID NO: 515)) whereas a stop codon TAA was inserted between mAb6_2.7 heavy chain and the Flag tag using a set of primers (Forward Primer: 5'-CTGTCTCCGGGTTAAGATTACAAGG-3' (SEQ ID NO: 516) and Reverse Primer: 5'-CCTTGTAATCT-TAACCCGGAGACAG-3' (SEQ ID NO: 517)).

The multispecific common light chain antibody mAb2.10/mAb6_2.7 was expressed in Expi293F cells (Thermo Fisher Scientific, Waltham, MA, USA) according to the manufacturer's protocol by co-transfecting plasmids at a mass ratio of 1:1:2 encoding the heavy chain of mAb2.10 containing hole mutations and N297G (SEQ ID NO: 235), the heavy chain of mAb6_2.7 containing knob mutations and N297G (SEQ ID NO:192), and the light chain of mAb2 (SEQ ID NO: 169). Cells were harvested after 4 days and the clarified supernatant was applied to MAbSelect Sure columns (GE Healthcare, Chicago, IL, USA) equilibrated in PBS pH 7.5. Protein was eluted with 100 mM sodium citrate pH 3 and the pH neutralized by adding 1.5 M Tris-HCl pH 8.8. Protein containing fractions were pooled and buffer-exchanged into 50 mM Tris pH 8, 10 mM NaCl. The protein was then loaded onto a Capto S Impact column (GE Healthcare, Chicago, IL, USA) equilibrated in 50 mM Tris pH 8, 10 mM NaCl and eluted with a 30 CV gradient of 50 mM Bis-Tris pH 6.5, 10 mM NaCl.

The intact mass of the purified multispecific antibody molecule was confirmed using a Q Exactive (Thermo Scientific) mass spectrometer in combination with an Ultimate-3000 (Thermo Scientific) liquid chromatography system. Purified antibody was injected on a PLRP-S column (Agilent) that was connected to the liquid chromatography system. The intact mass spectrometry analysis verified that the observed mass matched the predicted mass of the heterodimer. The absence of homodimer species was also confirmed by using the Fabricator enzyme (Genovis) that generated a homogenous pool of F(ab')2 and Fc/2 fragments. Each fragment matched the predicted mass.

Capto S elution fractions containing mAb2.10/mAb6_2.7, as identified by intact mass spectrometry, were pooled, and loaded onto a Superdex 200 µg column (GE Healthcare, Chicago, IL, USA). Peak fractions containing monodisperse protein were pooled and stored in 1×PBS, pH 7.5.

Example 7: Non-Specific Binding Assessment of Anti-IL-36 Multispecific Antibody mAb2.10/mAb6_2.7

Non-specific binding of multispecific molecule mAb2.10/mAb6_2.7 IgG was assessed using baculovirus ELISA (Hotzel et al., 2012). Briefly, baculovirus particles were coated on 96-well Maxisorp plates at a 3% suspension at 4° C. overnight. The plates were then blocked in PBS with 1% BSA and 0.05% Tween-20 at room temperature for one hour. mAb2.10/mAb6_2.7 IgG at 300 nM, 100 nM, and 33 nM in 1×PBS containing 0.5% BSA and 0.05% Tween 20 (ELISA buffer) were added to the plates for 1 hour and the plate was washed with 1×PBS with 0.05% Tween 20 (wash buffer). Bound antibodies were detected with goat anti-human IgG conjugated to horseradish peroxidase (Jackson ImmunoResearch) in ELISA buffer. The plate was incubated at room temperature for one hour with agitation, washed six times with wash buffer and developed for 15 minutes by addition of 100 µL/well of 1 Step Turbo TMB substrate (ThermoFisher, Cat #34022). Enzymatic reaction was stopped using 50 µL/well of 2 N $H_2SO_4$. Plates were analyzed using a Perkin Elmer plate reader (Envision 2103 multilabel reader) at 450 nm and compared to reference antibodies. Compared to positive control, multispecific molecule mAb2.10/mAb6_2.7 IgG showed no detectable baculovirus ELISA signal, indicating absence of non-specific binding to baculovirus particles (Table 15).

TABLE 15

Baculovirus ELISA evaluating non-specific binding of
multispecific anti-IL-36 antibody mAb2.10/mAb6_2.7 IgG

| Samples | 300 nM | 100 nM | 33 nM | 0 nM |
|---|---|---|---|---|
| Negative Control | 0.047 | 0.048 | 0.056 | 0.041 |
| Medium Positive Control | 0.386 | 0.164 | 0.081 | 0.039 |
| mAb2.10/mAb6_2.7 | 0.073 | 0.053 | 0.045 | 0.040 |

Example 8: In Vitro Assessment of Activity of Anti-hu-IL-36 Multispecific Antibody mAb2.10/mAb6_2.7 IgG Binding Kinetics of Anti-IL-36 Multispecific Antibody mAb2.10/mAb6_2.7

Surface plasmon resonance (SPR) analysis was used to determine the binding affinity for human and cynomolgus monkey IL-36 ("hu-IL-36" and "cy-IL-36," respectively) using a BIACORET™ 8K instrument as described in Example 2. In-vivo biotinylated hu-IL-36α-Avi, hu-IL-36β-Avi, hu-IL-36γ-Avi, cy-IL-36α-Avi, cy-IL-36β-Avi, or cy-IL-36γ-Avi were analyzed separately for binding to mAb2.10/mAb6_2.7. Briefly, a 1:4 dilution of Biotin CAPture Reagent (GE Healthcare) into HBS-EP buffer (0.01 M HEPES pH 7.4, 0.15 M NaCl, 3 mM EDTA, 0.005% Surfactant P20) was applied to a CAP sensor chip at 2 μL/min flow rate. For kinetics measurements, 1 nM biotinylated human and cyno IL-36α-Avi, IL-36γ-Avi; 0.8 nM biotinylated human and cyno IL-36β-Avi were captured at 10 μL/min to achieve 15-25 response units in the second flow cell (FC2). FC1 was kept as a reference. Next, 2-fold serial dilutions of mAb2.10/mAb6_2.7 protein in HBS-P buffer (0.01 M HEPES pH 7.4, 0.15 M NaCl, 0.005% surfactant P20) from low (1.56 nM) to high (200 nM) were injected (flow rate: 30 μL/min) at either 25° C. or 37° C. The sensorgram was recorded and subject to reference and buffer subtraction before data analysis with the BIACORE® 8K Evaluation Software (version 1.1.1.7442). Since each multispecific IgG antibody contains only one Fab arm capable of binding to one IL-36 protein being assayed, the binding interaction is monovalent. Association rates ($k_{on}$) and dissociation rates ($k_{off}$) were calculated using a simple one-to-one Langmuir binding model. The equilibrium dissociation constant ($K_D$) was calculated as the ratio of $k_{off}/k_{on}$.

The Biacore affinity results for mAb2.10/mAb6_2.7 are summarized below in Table 16. mAb2.10/mAb6_2.7 binds to all human and cynomolgus monkey IL-36 cytokines with high and comparable affinities.

TABLE 16

Affinity of mAb2.10/mAb6_2.7 multispecific antibody for hu-IL-36 and cy-IL-36

| | 25° C. | | | 37° C. | | |
|---|---|---|---|---|---|---|
| Ligand | $k_{on}$ (1/Ms) | $k_{off}$ (1/s) | $K_D$ (nM) | $k_{on}$ (1/Ms) | $k_{off}$ (1/s) | $K_D$ (nM) |
| hu-IL-36α | 1.34*10$^5$ | 1.57*10$^{-4}$ | 1.17 | 2.23*10$^5$ | 4.34*10$^{-4}$ | 1.95 |
| hu-IL-36β | 7.6*10$^4$ | 4.77*10$^{-5}$ | 0.63 | 9.14*10$^4$ | 1.68*10$^{-4}$ | 1.84 |
| hu-IL-36γ | 1.71*10$^5$ | 1.22*10$^{-4}$ | 0.72 | 2.1*10$^5$ | 3.41*10$^{-4}$ | 1.63 |
| cy-IL-36α | 1.74*10$^5$ | 3.35*10$^{-4}$ | 1.93 | 2.43*10$^5$ | 6.25*10$^{-4}$ | 2.57 |
| cy-IL-36β | 6.52*10$^4$ | 6.32*10$^{-5}$ | 0.97 | 8.69*10$^4$ | 2.18*10$^{-4}$ | 2.51 |
| cy-IL-36γ | 1.65*10$^5$ | 1.3*10$^{-4}$ | 0.79 | 1.58*10$^5$ | 1.48*10$^{-4}$ | 0.94 |

Blocking Activity of Multispecific Antibody mAb2.10/mAb6_2.7 in IL-36-Stimulated IL-8 Secretion by HaCat Cells To determine the blocking potency and efficacy of the multispecific antibody mAb2.10/mAb6_2.7, we evaluated its ability to inhibit hu-IL-36-stimulated IL-8 secretion by HaCat cells. A human IgG isotype control ("Hu IgG1 Ctrl") was also assayed to serve as a negative control. HaCat cell assays were performed as described in Example 2 except that recombinantly expressed mAb2.10/mAb6_2.7 or Hu IgG1 Ctrl were used as antagonists. Briefly, mAb2.10/mAb6_2.7, or an appropriate antibody control (e.g., Hu IgG1 Ctrl), was incubated with HaCat cells for 1 hour at 37° C., followed by the addition of agonist (hu-IL-36α, hu-IL-36β, or hu-IL-36γ). The experiment was allowed to proceed for an additional 24 hours (37° C. with 5% $CO_2$), with cell culture supernatants collected.

Quantification of IL-8 in supernatants performed using Cisbio Bioassay's, HTRF technology based human IL-8 assay. The assay was performed according to manufacturer guidelines. An HTRF compatible Spectramax (Molecular Devices) was used to obtain raw data and calculate the ratio of the acceptor to donor emission signals at 665 nm and 620 nm respectively in conjunction with SoftMax Pro software (Molecular Devices). The data obtained was analyzed using GraphPad Prism software, with interpolations performed using linear regression analysis and weighting defined by "Weight by $1/Y^2$". Interpolated data was then analyzed using standard non-linear regression 3 parameter analysis to derive agonist $EC_{50}$ and antibody $IC_{50}$ values.

Figure 3A:
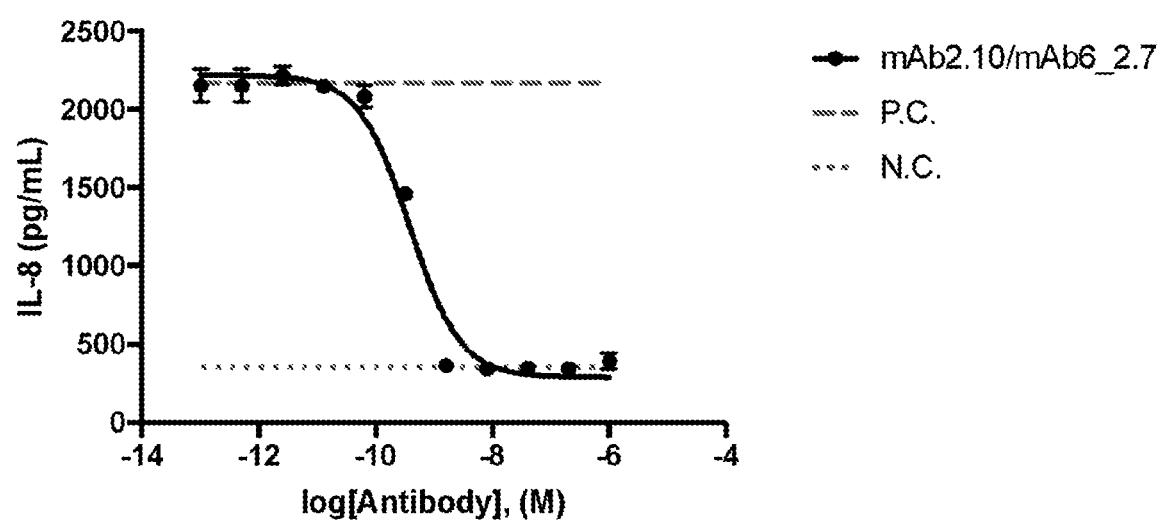
FIG. 3A, FIG. 3B, and FIG. 3C depict plots of results for the anti-hu-IL-36 multispecific antibody mAb2.10/mAb6_2.7 in inhibition assays of IL-36-stimulated intracellular signaling in the HaCat human keratinocyte cell line.
Figure 3B:
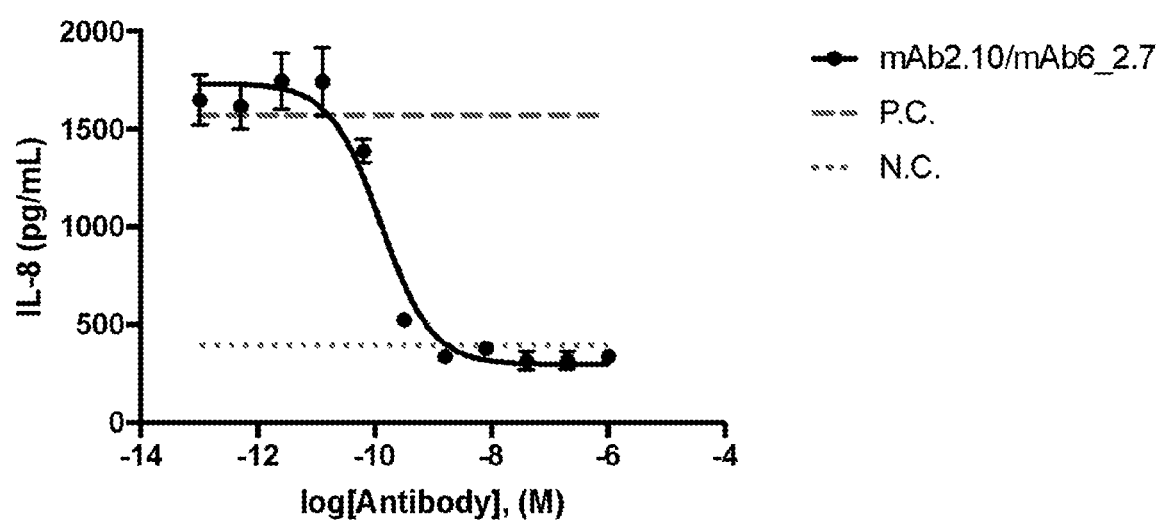
Figure 3C:
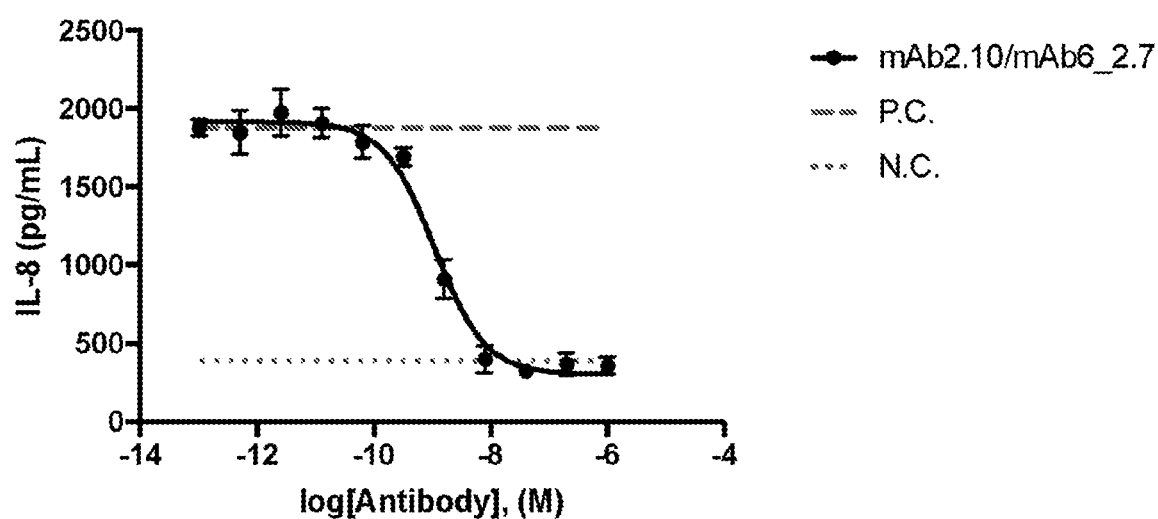

As shown in FIG. 3A, FIG. 3B, and FIG. 3C, mAb2.10/mAb6_2.7 demonstrated potent blocking activity of IL-36α-, IL-36β- and IL-36γ-mediated IL-8 production in HaCat cells, with $IC_{50}$ values of approximately 0.38 nM, 0.13 nM, and 1.1 nM, respectively. At 8 nM mAb2.10/mAb6_2.7, 100% of IL-36α-, IL-36β- and IL-36γ-mediated IL-8 production in HaCat cells was inhibited.

Blocking Activity of Multispecific Antibody mAb2.10/mAb6_2.7 in IL-36-Stimulated IL-8 Secretion by Primary Human Keratinocytes To determine the blocking potency and efficacy of the multispecific antibody mAb2.10/mAb6_2.7 on primary human cells, we evaluated its ability to inhibit hu-IL-36-stimulated IL-8 secretion by primary adult human keratinocytes. A human IgG isotype control ("Hu IgG1 Ctrl") was also assayed to serve as a negative control. Adult normal human epidermal keratinocytes were obtained from Lonza. Cells were isolated from normal (disease free) donated human tissue and cryopreserved by the manufacturer. The cells were thawed and maintained using the general guidelines recommended by the manufacturer. HEKa cells were maintained in a growth medium consisting of supplemented keratinocyte growth media from the Gold BulletKit (Lonza). The day prior to experimental use, HEKa were seeded on flat-bottom, 96-well plates at 10,000 cells/well to be at ~80-85% confluency the day of use. Primary keratinocyte cell assays were performed as described in Example 2 with adult human keratinocytes (HEKa), except that recombinantly expressed mAb2.10/mAb6_2.7 or Hu IgG1 Ctrl were used as antagonists. Briefly, mAb2.10/mAb6_2.7, or an appropriate antibody control (e.g., Hu IgG1 Ctrl), was incubated with HEKa cells for 1 hour at 37° C., followed by the addition of agonist (hu-IL-36α, hu-IL-36β, or hu-IL-36γ). The experiment was allowed to proceed for an additional 24 hours (37° C. with 5% $CO_2$), with cell culture supernatants collected and quantification of IL-8 performed using Cisbio Bioassay's, HTRF technology based human IL-8 assay as described above. Interpolated data was then analyzed using standard non-linear regression analysis in GraphPad Prism software to derive antibody $IC_{50}$ values.

Figure 4A:
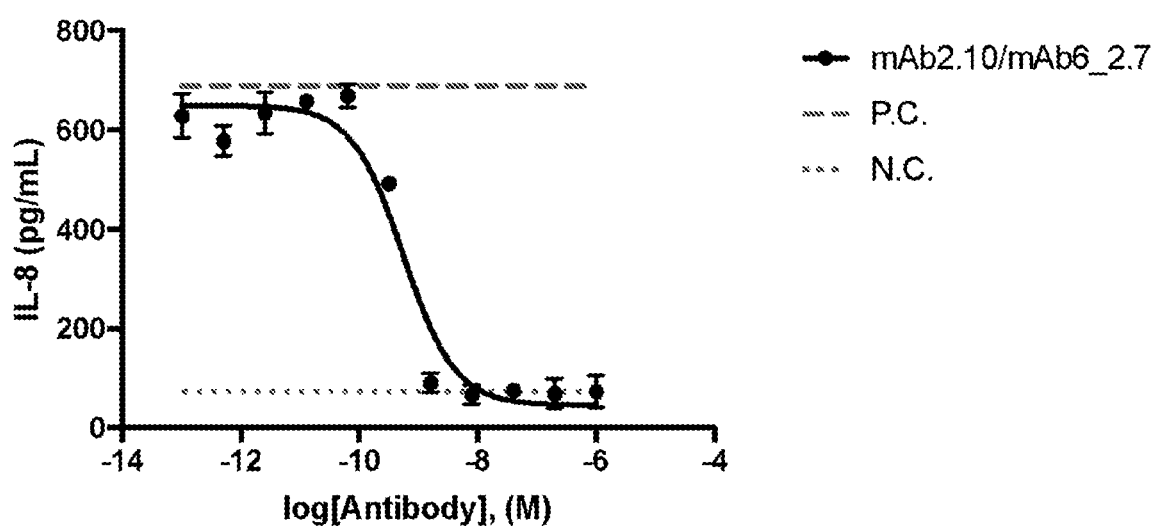
FIG. 4A, FIG. 4B, and FIG. 4C depict plots of results for the anti-hu-IL-36 multispecific antibody mAb2.10/mAb6_2.7 in inhibition assays of IL-36-stimulated intracellular signaling in primary human adult keratinocytes (HEKa).
Figure 4B:
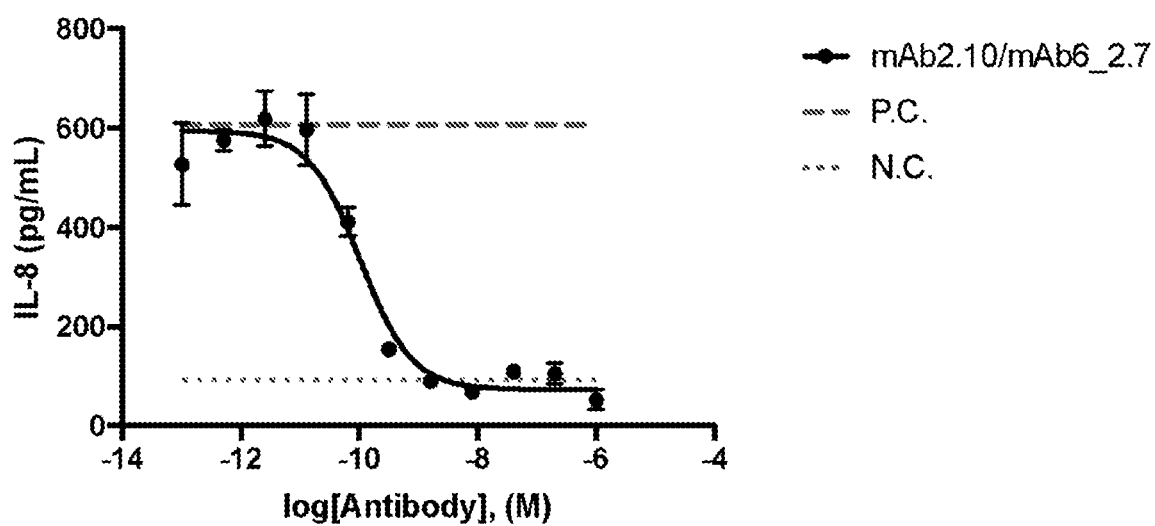
Figure 4C:
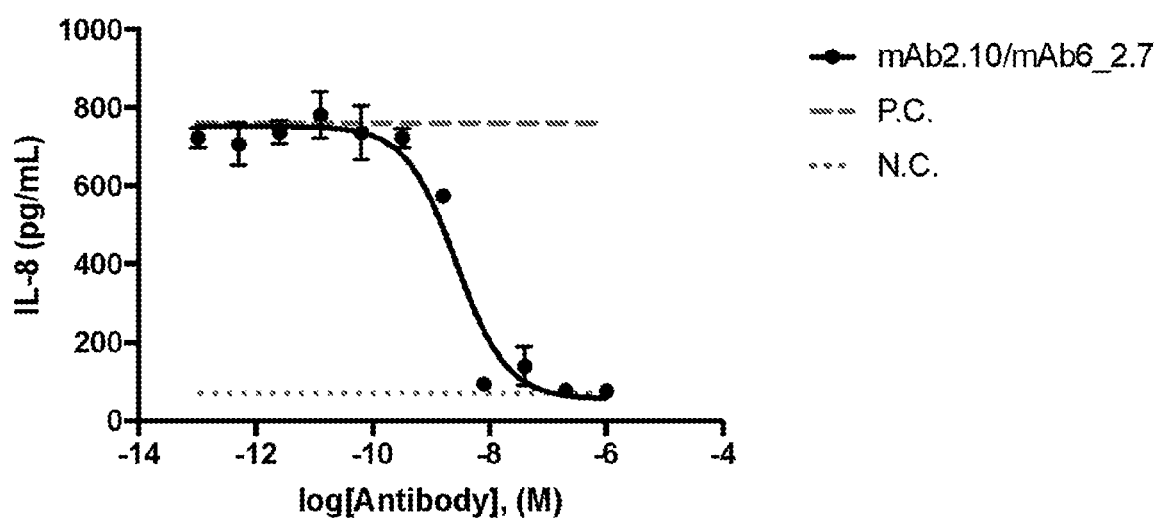

As shown in FIG. 4A, FIG. 4B, and FIG. 4C, mAb2.10/mAb6_2.7 demonstrated potent blocking activity of IL-36α-, IL-36β- and IL-36γ-mediated IL-8 production in primary human adult keratinocytes, with $IC_{50}$ values of approximately 0.56 nM, 0.11 nM, and 2.7 nM, respectively. At 8 nM mAb2.10/mAb6_2.7, 100% of IL-36α-, IL-36β- and IL-36γ-mediated IL-8 production in primary human adult keratinocytes was inhibited. This example demonstrates that the potency of mAb2.10/mAb6_2.7 on primary human cells is similar to that observed on the human keratinocyte cell line HaCat.

To demonstrate the independent blocking activity of the Fab arms in the multispecific antibody mAb2.10/mAb6_2.7 we evaluated its ability to inhibit IL-8 secretion by primary adult human keratinocytes stimulated by a mixture of hu-IL-36α and hu-IL-36β using methods similar to those described above with the following modification. mAb2.10/ mAb6_2.7, or an appropriate antibody control (e.g., Hu IgG1 Ctrl), was incubated with HEKa cells for 1 hour at 37° C., followed by the addition of agonists (hu-IL-36α individually, hu-IL-36β individually, or a mixture of hu-IL-36α and hu-IL-36β at approximately the $EC_{50}$ of each cytokine). mAb2.10/mAb6_2.7 demonstrated potent blocking activity of a mixture of IL-36α and IL-36β, with an $IC_{50}$ value of approximately 0.44 nM. The $IC_{50}$ values of mAb2.10/mAb6_2.7 against IL-36α and IL-36β individually were consistent with the blocking $IC_{50}$ values reported for primary human adult keratinocytes above in this example, demonstrating that the IL-36α/IL-36γ- and IL-36β-targeting Fab arms of mAb2.10/mAb6_2.7 potently and independently neutralize IL-36α, IL-36β and IL-36γ.

To determine the potency and efficacy of the multispecific antibody mAb2.10/mAb6_2.7 against a mixture of IL-36 agonist cytokines, we evaluated the ability of the antibody to block signaling by a mixture of IL-36α, IL-36β and IL-36γ on primary cells. The ability of mAb2.10/mAb6_2.7 to inhibit IL-8 secretion by primary adult human keratinocytes stimulated by mixtures of hu-IL-36α, hu-IL-36β and IL-36γ was assessed using methods similar to those described above with the following modifications. mAb2.10/mAb6_2.7, or an appropriate antibody control (e.g., Hu IgG1 Ctrl), was incubated with HEKa cells for 1 hour at 37° C., followed by the addition of a mixture of agonists (hu-IL-36α, hu-IL-36β, and hu-IL-36γ at approximately the $EC_{50}$-$EC_{65}$ of each cytokine). The $IC_{50}$ value of mAb2.10/mAb6_2.7 was determined to be 1.16 nM by titrating it in the presence of the described cytokine mixture, demonstrating potent blocking activity in mixtures containing IL-36α, IL-36β, and IL-36γ.

Notwithstanding the appended claims, the disclosure set forth herein is also defined by the following clauses, which may be beneficial alone or in combination, with one or more other causes or embodiments. Without limiting the foregoing description, certain non-limiting clauses of the disclosure numbered as below are provided, wherein each of the individually numbered clauses may be used or combined with any of the preceding or following clauses. Thus, this is intended to provide support for all such combinations and is not necessarily limited to specific combinations explicitly provided below:

1. An anti-IL-36 antibody comprising: (i) a first light chain hypervariable region (HVR-L1), a second light chain hypervariable region (HVR-L2), and a third light chain hypervariable region (HVR-L3), and/or (ii) a first heavy chain hypervariable region (HVR-H1), a second heavy chain hypervariable region (HVR-H2), and a third heavy chain hypervariable region (HVR-H3); wherein:
   (a) HVR-L1 comprises an amino acid sequence selected from TGSSSNIGAHYDVH (SEQ ID NO: 18), TGSSSNIGAGYDVH (SEQ ID NO: 22), RASQSVSSNYLA (SEQ ID NO: 38), or RASQTIYKYLN (SEQ ID NO: 42);
   (b) HVR-L2 comprises an amino acid sequence selected from SNNNRPS (SEQ ID NO: 15), GNDNRPS (SEQ ID NO: 19), GNTNRPS (SEQ ID NO: 23), GNRNRPS (SEQ ID NO: 27), SASSLQS (SEQ ID NO: 39), or AASSLQS (SEQ ID NO: 43);
   (c) HVR-L3 comprises an amino acid sequence selected from QSYDYSLRGYV (SEQ ID NO: 16), QSYDYSLSGYV (SEQ ID NO: 20), QSYDYSLRVYV (SEQ ID NO: 28), QSYDYSLKAYV (SEQ ID NO: 32), QSYDISLSGWV (SEQ ID NO: 36), QQTYSYPPT (SEQ ID NO: 40), or QQSSIPYT (SEQ ID NO: 44);
   (d) HVR-H1 comprises an amino acid sequence selected from SAYAMHW (SEQ ID NO: 46), STSSYYW (SEQ ID NO: 50), SSTSYYW (SEQ ID NO: 54), GSRSYYW (SEQ ID NO: 58), STYAMSW (SEQ ID NO: 62), TSSNYYW (SEQ ID NO: 66), SSYGMH (SEQ ID NO: 70), SNYAIS (SEQ ID NO: 74), TSTNYYW (SEQ ID NO: 82), TSSNAYW (SEQ ID NO: 86), TASNYYW (SEQ ID NO: 90), TASNTYW (SEQ ID NO: 106), SDSSYYW (SEQ ID NO: 122), SESSYYW (SEQ ID NO: 126), STSSDYW (SEQ ID NO: 130), SNSSYYW (SEQ ID NO: 134), STSSYHW (SEQ ID NO: 142), SRSSYYW (SEQ ID NO: 146), XXXNXYX (SEQ ID NO: 251) wherein X at position 1 is T, D, E, or N; X at position 2 is S, A, E, G, K, Q, R, or T; X at position 3 is S, A, D, E, G, N, P, Q, or T; X at position 5 is Y, A, E, G, H, M, N, Q, S, T, or V; X at position 7 is W, F, I, V, or Y, or XXXXXXW (SEQ ID NO: 336) wherein X at position 1 is S or D; X at position 2 is T, A, D, E, G, H, K, N, P, Q, R, or S; X at position 3 is S, D, E, G, K, N, P, or R; X at position 4 is S, G, K, N, or P; X at position 5 is Y, A, D, E, G, H, M, N, Q, S, T, or W; X at position 6 is Y, A, F, G, H, M, N, or Q;
   (e) HVR-H2 comprises an amino acid sequence selected from VISYDGTNEYYAD (SEQ ID NO: 47), SIYYTGNTYYNP (SEQ ID NO: 51), SIHYSGNTYYNP (SEQ ID NO: 55), SIHYSGTTYYNP (SEQ ID NO: 59), GISGGSGYTYYAD (SEQ ID NO: 63), SIDYTGSTYYNP (SEQ ID NO: 67), VISYGGSERYYAD (SEQ ID NO: 71), GILPILGTVDYAQ (SEQ ID NO: 75), NIDYTGSTYYNA (SEQ ID NO: 83), SIDYTGSTAYNP (SEQ ID NO: 87), SIDYTGSTYYNT (SEQ ID NO: 91), SIDYTGSTYYEP (SEQ ID NO: 99), SIDYTGSTYYEP (SEQ ID NO: 103), SIDYTGSTYYQP (SEQ ID NO: 119), SIYYTGNTYYNS (SEQ ID NO: 123), SIYYTGNTYYLP (SEQ ID NO: 131), SIYYTGNTYYMP (SEQ ID NO: 143), SIYYTGNTYYWP (SEQ ID NO: 147), SIYYTGETYYAP (SEQ ID NO: 151), XXDXXXXXXXYXX (SEQ ID NO: 284) wherein X at position 1 is S, N, or T; X at position 2 is I, M, or V; X at position 4 is Y, or H; X at position 5 is T, H, L, or N; X at position 6 is G, A, D, E, H, K, N, Q, R, S, or T; X at position 7 is S, A, D, Q, or T; X at position 8 is T, A, D, or E; X at position 9 is Y, A, F, Q, S, or W; X at position 11 is N, D, E, H, P, or Q; X at position 12 is P, A, or E, or XXXXXXXXXYXP (SEQ ID NO: 379) wherein X at position 1 is S, F, I, M, or Q; X at position 2 is I, A, G, L, R, S, T, or V; X at position 3 is Y, A, D, E, F, G, H, K, L, M, N, P, Q, R, S, T, or W; X at position 4 is Y, A, D, E, F, G, H, K, N, P, Q, R, S, T, or W; X at position 5 is T, D, E, K, N, P, or Q; X at position 6 is G or Q; X at position 7 is N, D, E, G, H, I, K, M, P, R, or S; X at position 8 is T, A, E, F, G, H, K, P, Q, R, S, V, W, or Y; X at position 9 is Y or W; X at position 11 is N, A, D, E, K, L, M, P, Q, S or T;
   (f) HVR-H3 comprises an amino acid sequence selected from ARGIRIFTSYFDS (SEQ ID NO: 48), ARVRYGVGVPRYFDP (SEQ ID NO: 52), ARVHYGGYIPRRFDH (SEQ ID NO: 56), ARVAPSYPRVFDY (SEQ ID NO: 60), ARVVTYRDPPASFDY (SEQ ID NO: 64), ARGKYYETYLGFDV (SEQ ID NO: 68), AREPWYSSRGWTGYGFDV (SEQ ID NO: 72), AREPWYRLGAFDV (SEQ ID NO: 76), ATGKYY- ETYLGFDV (SEQ ID NO: 84), AHGKYYETYLGFDV (SEQ ID NO: 88), ATGSYYETYLGFDV (SEQ ID NO: 100), ATGNYYETYLGFDV (SEQ ID NO: 104), ASGKYYETYLGFDV (SEQ ID NO: 112), ARGNYYETYLGFDV (SEQ ID NO: 120), AGVRYGVGVPRYFDP (SEQ ID NO: 128), SRVRYGVGVPRYFDP (SEQ ID NO: 132), VRVRYGVGVPRYFDP (SEQ ID NO: 144), TRVRYGVGVPRYFDP (SEQ ID NO: 148), ARLRYGVGVPRYFDP (SEQ ID NO: 152), ARVKYGVGVPRYFDP (SEQ ID NO: 156), ARVRYGVGVPRHFDP (SEQ ID NO: 160), AXGXYYXTYLGFDV (SEQ ID NO: 322) wherein X at position 2 is R, A, E, G, H, M, N, Q, S, T, or Y; X at position 4 is K, A, or S; X at position 7 is E or T, or XXXXXGXXVPRXFDP (SEQ ID NO: 462) wherein X at position 1 is A or V; X at position 2 is R, A, G, N, Q, or T; X at position 3 is V, A, F, I, K, L, M, Q, or S; X at position 4 is R, A, I, K, L, M, P, Q, S, T, or V; X at position 5 is Y, H, I, L, or V; X at position 7 is V, A, F, G, K, M, N, Q, R, S, T, W, or Y; X at position 8 is G, N, R, S, or T; X at position 12 is Y, F, H, I, L, M, Q, or R.

2. The antibody of clause 1, wherein:
   (a) HVR-L1 comprises the amino acid sequence of SEQ ID NO: 18;
   (b) HVR-L2 comprises the amino acid sequence of SEQ ID NO: 19; and
   (c) HVR-L3 comprises the amino acid sequence of SEQ ID NO: 20.

3. The antibody of any one of clauses 1-2, wherein:
   (a) HVR-H1 comprises the amino acid sequence selected from SEQ ID NO: 66, 82, 86, 90, or 252-283;
   (b) HVR-H2 comprises the amino acid sequence selected from SEQ ID NO: 67, 83, 87, 91, 99, 103, 119, or 285-321; and
   (c) HVR-H3 comprises the amino acid sequence selected from SEQ ID NO: 68, 84, 88, 100, 104, 112, 120, or 323-335.

4. The antibody of any one of clauses 1-2, wherein:
   (a) HVR-H1 comprises an amino acid sequence selected from SEQ ID NO: 50, 122, 126, 130, 134, 138, 142, 146, or 337-378;
   (b) HVR-H2 comprises an amino acid sequence selected from SEQ ID NO: 51, 123, 131, 143, 147, 151, or 380-461; and
   (c) HVR-H3 comprises an amino acid sequence selected from SEQ ID NO: 52, 128, 132, 144, 148, 152, 156, 160, or 463-513.

5. The antibody of clause 1, wherein:
   (a) HVR-L1 comprises the amino acid sequence of SEQ ID NO: 18;
   (b) HVR-L2 comprises the amino acid sequence of SEQ ID NO: 19;
   (c) HVR-L3 comprises the amino acid sequence of SEQ ID NO: 20;
   (d) HVR-H1 comprises the amino acid sequence selected from SEQ ID NO: 66, 82, 86, 90, or 252-283;
   (e) HVR-H2 comprises the amino acid sequence selected from SEQ ID NO: 67, 83, 87, 91, 99, 103, 119, or 285-321; and
   (f) HVR-H3 comprises the amino acid sequence selected from SEQ ID NO: 68, 84, 88, 100, 104, 112, 120, or 323-335.

6. The antibody of clause 1, wherein:
   (a) HVR-L1 comprises the amino acid sequence of SEQ ID NO: 18;
   (b) HVR-L2 comprises the amino acid sequence of SEQ ID NO: 19;
   (c) HVR-L3 comprises the amino acid sequence of SEQ ID NO: 20;
   (d) HVR-H1 comprises an amino acid sequence selected from SEQ ID NO: 50, 122, 126, 130, 134, 138, 142, 146, or 337-378;
   (e) HVR-H2 comprises an amino acid sequence selected from SEQ ID NO: 51, 123, 131, 143, 147, 151, or 380-461; and
   (f) HVR-H3 comprises an amino acid sequence selected from SEQ ID NO: 52, 128, 132, 144, 148, 152, 156, 160, or 463-513.

7. The antibody of any one of clauses 1-6, wherein the antibody comprises a light chain variable domain ($V_L$) amino acid sequence having at least 90% identity to a sequence selected from SEQ ID NO: 13, 17, 21, 25, 29, 33, 37, 41, 77, or 78; and/or a heavy chain variable domain ($V_H$) amino acid sequence having at least 90% identity to a sequence selected from SEQ ID NO: 45, 49, 53, 57, 61, 65, 69, 73, 79, 80, 81, 85, 89, 93, 97, 101, 105, 109, 113, 117, 121, 125, 129, 133, 137, 141, 145, 149, 153, 157, 161, or 165.

8. The antibody of any one of clauses 1-6, wherein the antibody comprises a light chain variable domain ($V_L$) amino acid sequence having at least 90% identity to SEQ ID NO: 17 or 77; and/or a heavy chain variable domain ($V_H$) amino acid sequence having at least 90% identity to a sequence selected from SEQ ID NO: 49, 65, 79, 80, 81, 85, 89, 93, 97, 101, 105, 109, 113, 117, 121, 125, 129, 133, 137, 141, 145, 149, 153, 157, 161, or 165.

9. The antibody of any one of clauses 1-6, wherein the antibody comprises a light chain variable domain ($V_L$) amino acid sequence having at least 90% identity to SEQ ID NO: 17 or 77; and/or a heavy chain variable domain ($V_H$) amino acid sequence having at least 90% identity to a sequence selected from SEQ ID NO: 65, 80, 81, 85, 89, 93, 97, 101, 105, 109, 113, or 117.

10. The antibody of any one of clauses 1-6, wherein the antibody comprises a light chain variable domain ($V_L$) amino acid sequence having at least 90% identity to SEQ ID NO: 17 or 77; and/or a heavy chain variable domain ($V_H$) amino acid sequence having at least 90% identity to a sequence selected from SEQ ID NO: 49, 79, 121, 125, 129, 133, 137, 141, 145, 149, 153, 157, 161, or 165.

11. The antibody of any one of clauses 1-10, wherein the antibody comprises a light chain (LC) amino acid sequence having at least 90% identity to SEQ ID NO: 169 or 242; and/or a heavy chain (HC) amino acid sequence having at least 90% identity to a sequence selected from SEQ ID NO: 170-202, 248-250, 518-616, and 743-751.

12. The antibody of any one of clauses 1-10, wherein the antibody comprises a light chain (LC) amino acid sequence having at least 90% identity to SEQ ID NO: 169 or 242; and/or a heavy chain (HC) amino acid sequence having at least 90% identity to a sequence selected from SEQ ID NO: 203-241, and 617-733.

13. An anti-IL-36 antibody comprising a light chain variable domain ($V_L$) amino acid sequence having at least 90% identity to a sequence selected from SEQ ID NO: 13, 17, 21, 25, 29, 33, 37, 41, 77, or 78; and/or a heavy chain variable domain (V$_H$) amino acid sequence having at least 90% identity to a sequence selected from SEQ ID NO: 45, 49, 53, 57, 61, 65, 69, 73, 79, 80, 81, 85, 89, 93, 97, 101, 105, 109, 113, 117, 121, 125, 129, 133, 137, 141, 145, 149, 153, 157, 161, or 165.

14. An anti-IL-36 antibody comprising a light chain variable domain (V$_L$) amino acid sequence selected from SEQ ID NO: 13, 17, 21, 25, 29, 33, 37, 41, 77, or 78; and/or a heavy chain variable domain (V$_H$) amino acid sequence selected from SEQ ID NO: 45, 49, 53, 57, 61, 65, 69, 73, 79, 80, 81, 85, 89, 93, 97, 101, 105, 109, 113, 117, 121, 125, 129, 133, 137, 141, 145, 149, 153, 157, 161, or 165.

15. An anti-IL-36 antibody comprising a light chain variable domain (V$_L$) amino acid sequence having at least 90% identity to SEQ ID NO: 17 or 77; and/or a heavy chain variable domain (V$_H$) amino acid sequence having at least 90% identity to a sequence selected from SEQ ID NO: 49, 65, 79, 80, 81, 85, 89, 93, 97, 101, 105, 109, 113, 117, 121, 125, 129, 133, 137, 141, 145, 149, 153, 157, 161, or 165.

16. An anti-IL-36 antibody comprising a light chain variable domain (V$_L$) amino acid sequence of SEQ ID NO: 17 or 77; and/or a heavy chain variable domain (V$_H$) amino acid sequence selected from SEQ ID NO: 49, 65, 79, 80, 81, 85, 89, 93, 97, 101, 105, 109, 113, 117, 121, 125, 129, 133, 137, 141, 145, 149, 153, 157, 161, or 165.

17. An anti-IL-36 antibody comprising a light chain variable domain (V$_L$) amino acid sequence having at least 90% identity to SEQ ID NO: 17 or 77; and/or a heavy chain variable domain (V$_H$) amino acid sequence having at least 90% identity to a sequence selected from SEQ ID NO: 65, 80, 81, 85, 89, 93, 97, 101, 105, 109, 113, or 117.

18. An anti-IL-36 antibody comprising a light chain variable domain (V$_L$) amino acid sequence of SEQ ID NO: 17 or 77; and/or a heavy chain variable domain (V$_H$) amino acid sequence selected from SEQ ID NO: 65, 80, 81, 85, 89, 93, 97, 101, 105, 109, 113, or 117.

19. An anti-IL-36 antibody comprising a light chain variable domain (V$_L$) amino acid sequence having at least 90% identity to SEQ ID NO: 17 or 77; and/or a heavy chain variable domain (V$_H$) amino acid sequence having at least 90% identity to a sequence selected from SEQ ID NO: 49, 79, 121, 125, 129, 133, 137, 141, 145, 149, 153, 157, 161, or 165.

20. An anti-IL-36 antibody comprising a light chain variable domain (V$_L$) amino acid sequence of SEQ ID NO: 17 or 77; and/or a heavy chain variable domain (V$_H$) amino acid sequence selected from SEQ ID NO: 49, 79, 121, 125, 129, 133, 137, 141, 145, 149, 153, 157, 161, or 165.

21. An anti-IL-36 antibody comprising a light chain (LC) amino acid sequence having at least 90% identity to SEQ ID NO: 169 or 242; and/or a heavy chain (HC) amino acid sequence having at least 90% identity to a sequence selected from SEQ ID NO: 170-202, 248, 249-250, 518-616, and 743-751.

22. An anti-IL-36 antibody comprising a light chain (LC) amino acid sequence of SEQ ID NO: 169 or 242; and/or a heavy chain (HC) amino acid sequence selected from SEQ ID NO: 170-202, 248-250, 518-616, and 743-751.

23. An anti-IL-36 antibody comprising a light chain (LC) amino acid sequence having at least 90% identity to SEQ ID NO: 169 or 242; and/or a heavy chain (HC) amino acid sequence having at least 90% identity to a sequence selected from SEQ ID NO: 203-241, and 617-733.

24. An anti-IL-36 antibody comprising a light chain (LC) amino acid sequence of SEQ ID NO: 169 or 242; and/or a heavy chain (HC) amino acid sequence selected from SEQ ID NO: 206-241.

25. An anti-IL-36 antibody, wherein the antibody is a multispecific antibody comprising:
   (a) a pair of light chains each comprising: HVR-L1 sequence of SEQ ID NO: 18; HVR-L2 sequence of SEQ ID NO: 19; and HVR-L3 sequence of SEQ ID NO: 20;
   (b) a heavy chain comprising: HVR-H1 sequence selected from SEQ ID NOs: 66, 82, 86, 90, or 106; HVR-H2 sequence selected from SEQ ID NOs: 67, 83, 87, 91, 99, 103, or 119; and HVR-H3 sequence selected from SEQ ID NOs: 68, 84, 88, 100, 104, 112, or 120; and
   (c) a heavy chain comprising: HVR-H1 sequence selected from SEQ ID NOs: 50, 122, 126, 130, 134, 142, or 146; HVR-H2 sequence selected from SEQ ID NOs: 51, 123, 127, 131, 135, 139, 143, 147, or 151; and HVR-H3 comprises an amino acid sequence selected from SEQ ID NOs: 52, 128, 132, 144, 148, 152, 156, or 160.

26. The antibody of clause 25 wherein one of the heavy chains comprises an amino acid substitution T366W and the other heavy chain comprises amino acid substitutions T366S, L368A and Y407V.

27. An anti-IL-36 antibody, wherein the antibody is a multispecific antibody comprising:
   (a) a pair of light chains each comprising a light chain variable domain (V$_L$) amino acid sequence of SEQ ID NO: 17 or 77;
   (b) a heavy chain comprising a heavy chain variable domain (V$_H$) amino acid sequence selected from SEQ ID NO: 65, 80, 81, 85, 89, 93, 97, 101, 105, 109, 113, or 117; and
   (c) a heavy chain comprising a heavy chain variable domain (V$_H$) amino acid sequence selected from SEQ ID NO: 49, 79, 121, 125, 129, 133, 137, 141, 145, 149, 153, 157, 161, or 165.

28. An anti-IL-36 antibody, wherein the antibody is a multispecific antibody comprising:
   (a) a pair of light chain (LC) amino acid sequences of SEQ ID NO: 169 and 242;
   (b) a heavy chain (HC) amino acid sequence selected from SEQ ID NO: 171, 174,177, 180, 183, 186, 189, 192, 195, 198, 201, and 249; and
   (c) a heavy chain (HC) amino acid sequence selected from SEQ ID NO: 208, 211, 214, 217, 220, 223, 226, 229, 232, 235, 238, and 241.

29. An anti-IL-36 antibody, wherein the antibody is a multispecific antibody comprising:
   (a) a pair of light chain (LC) amino acid sequences of SEQ ID NO: 169 and 242;
   (b) a heavy chain (HC) amino acid sequence selected from SEQ ID NO: 172, 175, 178, 181, 184, 187, 190, 193, 196, 199, 202, 250; and
   (c) a heavy chain (HC) amino acid sequence selected from SEQ ID NO: 207, 210, 213, 216, 219, 222, 225, 228, 231, 234, 237, and 240.

30. A multispecific anti-IL-36 antibody, wherein the antibody comprises a pair of light chain (LC) amino acid sequences of SEQ ID NO: 169; a heavy chain (HC)

amino acid sequence of SEQ ID NO: 192; and a heavy chain (HC) amino acid sequence of SEQ ID NO: 235.

31. The antibody of any one of clauses 1-30, wherein the antibody is a multispecific antibody comprising a specificity for IL-36α and IL-36γ in one arm, and a specificity for IL-36β in the other arm.
32. The antibody of any one of clauses 1-31, wherein the antibody binds to hu-IL-36α, hu-IL-36-β, and/or hu-IL-36-γ with a binding affinity of $1\times10^{-8}$ M or less, $1\times10^{-9}$ M or less, $1\times10^{-10}$ M or less, or $1\times10^{-11}$ M or less.
33. The antibody of any one of clauses 1-32, wherein the antibody binds to hu-IL-36α and hu-IL-36-γ with a binding affinity of $1\times10^{-8}$ M or less, $1\times10^{-9}$ M or less, $1\times10^{-10}$ M or less, or $1\times10^{-11}$ M or less.
34. The antibody of any one of clauses 1-33, wherein the antibody binds to hu-IL-36-β with a binding affinity of $1\times10^{-8}$ M or less, $1\times10^{-9}$ M or less, $1\times10^{-10}$ M or less, or $1\times10^{-11}$ M or less.
35. The antibody of any one of clauses 1-34, wherein the antibody decreases an intracellular signal stimulated by IL-36α, IL-36β, and/or IL-36γ by at least 90%, at least 95%, at least 99%, or 100%; optionally, wherein at an IL-36α, IL-36β, and/or IL-36γ concentration of about $EC_{50}$ the antibody has an $IC_{50}$ of 10 nM or less, 5 nM or less, or 1 nM or less.
36. The antibody of any one of clauses 1-35, wherein the antibody inhibits release of IL-8 from primary human keratinocytes (PHKs) stimulated by IL-36α, IL-36β, and/or IL-36γ, optionally, wherein at an IL-36α, IL-36β, and/or IL-36γ concentration of about $EC_{50}$ the antibody has an $IC_{50}$ of 10 nM or less, 5 nM or less, or 1 nM or less.
37. The antibody of any one of clauses 1-36, wherein the antibody cross-reacts with an IL-36α, IL-36β, or IL-36γ of cynomolgus monkey of SEQ ID NO: 5, 6, or 7.
38. The antibody of any one of clauses 1-37, wherein the antibody is a monoclonal antibody.
39. The antibody of any one of clauses 1-38, wherein the antibody is a recombinant antibody.
40. The antibody of any one of clauses 1-39, wherein the antibody is a chimeric antibody.
41. The antibody of any one of clauses 1-39, wherein the antibody is a humanized or human antibody.
42. The antibody of any one of clauses 1-41, wherein the antibody is an antibody fragment, optionally selected from the group consisting of F(ab')$_2$, Fab', Fab, Fv, single domain antibody (VHH), single-arm antibody, and scFv.
43. The antibody of any one of clauses 1-42, wherein the antibody is a full-length antibody of class IgG; optionally, wherein the class IgG antibody has an isotype selected from IgG1, IgG2, IgG3, and IgG4.
44. The antibody of clause 43, wherein the antibody is an Fc region variant; optionally wherein the Fc region variant alters effector function or alters half-life.
45. The antibody of clause 44, wherein the Fc region variant decreases effector function and/or results in an effectoriess antibody; optionally wherein the Fc region variant comprises an amino acid substitution at position 297 resulting in effectoriess function.
46. The antibody of any one of clauses 1-45, wherein the antibody is an immunoconjugate; optionally, wherein the immunoconjugate comprises a therapeutic agent for treatment of IL-36 mediated condition or disease; optionally, wherein the therapeutic agent is a chemotherapeutic agent or cytotoxic agent for the treatment of cancer.
47. The antibody of any one of clauses 1-47, wherein the antibody is a synthetic antibody comprising the CDRs grafted onto a scaffold other than an immunoglobulin scaffold or immunogbbulin framework, optionally a scaffold selected from an alternative protein scaffold, and an artificial polymer scaffold.
48. An anti-IL-36 antibody that specifically binds to the same epitope as the antibody of any one of clauses 1-48.
49. A multispecific antibody that binds to each of human IL-36α, IL-36β, and IL-36γ; optionally, wherein the antibody binds to each of human IL-36α, IL-36β, and IL-36γ with a binding affinity of 3 nM or less; optionally wherein the binding affinity is measured by equilibrium dissociation constant ($K_D$) to a hu-IL-36α of SEQ ID NO:1, a hu-IL-36β of SEQ ID NO:2, and a hu-IL-36γ of SEQ ID NO:3; optionally, wherein:
    (a) comprises a specificity for IL-36α and/or IL-36γ in one arm, and a specificity for IL-36β in the other arm; optionally, wherein one arm binds to hu-IL-36α and hu-IL-36-γ with a binding affinity of $1\times10^{-9}$ M or less, $1\times10^{-10}$ M or less, or $1\times10^{-11}$ M or less, and the other arm binds to hu-IL-36-β with a binding affinity of $1\times10^{-9}$ M or less, $1\times10^{-10}$ M or less, or $1\times10^{-11}$ M or less;
    (b) decreases an intracellular signal stimulated by IL-36α, IL-36β, and/or IL-36γ by at least 90%, at least 95%, at least 99%, or 100%; optionally, wherein at an IL-36α, IL-36β, and/or IL-36γ concentration of about $EC_{50}$ the antibody has an $IC_{50}$ of 10 nM or less, 5 nM or less, or 1 nM or less;
    (c) inhibits release of IL-8 from primary human keratinocytes (PHKs) stimulated by IL-36α, IL-36β, and/or IL-36γ, optionally, wherein at an IL-36α, IL-36β, and/or IL-36γ concentration of about $EC_{50}$ the antibody has an $IC_{50}$ of 10 nM or less, 5 nM or less, or 1 nM or less;
    (d) the antibody cross-reacts with an IL-36α, IL-36β, and IL-36γ of cynomolgus monkey; and/or
    (e) the antibody binds to each of cynomolgus monkey IL-36α, IL-36β, IL-36γ with a binding affinity of 3 nM or less; optionally wherein the binding affinity is measured by equilibrium dissociation constant ($K_D$) to a cy-IL-36α of SEQ ID NO:5, a cy-IL-36β of SEQ ID NO:6, and a cy-IL-36γ of SEQ ID NO:7.
50. An isolated polynucleotide encoding the antibody of any one of clauses 1-49.
51. The polynucleotide of clause 50, further comprising a nucleotide sequence encoding a signal peptide (SP).
52. The polynucleotide of clause 50, wherein the polynucleotide encodes a light chain and a heavy chain.
53. The polynucleotide of clause 50, wherein the polynucleotide comprises a polynucleotide sequence comprising one or more codons selected for optimal expression of the antibody in a mammalian cell.
54. The polynucleotide of clause 50, wherein the polynucleotide sequence comprises one or more codons selected for optimal expression of the antibody in a Chinese Hamster Ovary (CHO) cell.
55. A vector comprising a polynucleotide of any one of clauses 50-54.
56. An isolated host cell comprising the vector of clause 55.

57. A host cell comprising a polynucleotide of any one of clauses 50-54.
58. An isolated host cell that expresses the antibody of any one of clauses 1-49.
59. The host cell of clause 56, wherein the host cell is selected from a Chinese hamster ovary (CHO) cell, a myeloma cell (e.g., Y0, NS0, Sp2/0), a monkey kidney cell (COS-7), a human embryonic kidney line (293), a baby hamster kidney cell (BHK), a mouse Sertoli cell (e.g., TM4), an African green monkey kidney cell (VERO-76), a human cervical carcinoma cell (HELA), a canine kidney cell, a human lung cell (W138), a human liver cell (Hep G2), a mouse mammary tumor cell, a TR1 cell, an Medical Research Council 5 (MRC 5) cell, and a Foreskin 4 (FS4) cell.
60. A method of producing an antibody comprising culturing the host cell of any one of clauses 56-59 so that an antibody is produced.
61. A hybridoma that produces an antibody of any one of clauses 1-49.
62. A pharmaceutical composition comprising an antibody of any one of clauses 1-49 and a pharmaceutically acceptable carrier.
63. The pharmaceutical composition of clause 62, wherein the composition further comprises a therapeutic agent for treatment of an IL-36-mediated disease or condition; optionally, wherein the therapeutic agent is a chemotherapeutic agent.
64. A method of treating an IL-36-mediated disease in a subject, comprising administering to the subject a therapeutically effective amount of an antibody of any one of clauses 1-49, or a therapeutically effective amount of a pharmaceutical composition of clause 62.
65. A method of treating a disease mediated by IL-36α, IL-36β, and/or IL-36γ stimulated signaling in a subject, the method comprising administering to the subject a therapeutically effective amount of an antibody of any one of clauses 1-49, or a therapeutically effective amount of a pharmaceutical composition of clause 62.
66. The method of any one of clauses 64-65, wherein the disease is selected from: acne due to epidermal growth factor receptor inhibitors, acne and suppurative hidradenitis (PASH), acute generalized exanthematous pustuiosis (AGEP), amicrobial pustuiosis of the folds, amicrobial pustuiosis of the scalp/leg, amicrobial subcorneal pustuiosis, aseptic abscess syndrome, Behçet's disease, bowel bypass syndrome, chronic obstructive pulmonary disease (COPD), childhood pustular dermatosis, Crohn's disease, deficiency of the interleukin-1 receptor antagonist (DIRA), deficiency of interleukin-36 receptor antagonist (DITRA), eczema, generalized pustular psoriasis (GPP), erythema elevatum diutinum, hidradenitis suppurativa, IgA pemphigus, inflammatory bowel disease (IBD), neutrophilic panniculitis, palmoplantar pustular psoriasis (PPP), psoriasis, psoriatic arthritis, pustular psoriasis (DIRA, DITRA), pyoderma gangrenosum, pyogenic arthritis pyoderma gangrenosum and acne (PAPA), pyogenic arthritis pyoderma gangrenosum acne and suppurative hidradenitis (PA-PASH), rheumatoid neutrophilic dermatosis, synovitis acne pustulosis hyperostosis and osteitis (SAPHO), TNF-induced psoriasis form skin lesions in Crohn's patients, Sjogren's syndrome, Sweet's syndrome, systemic lupus erythematosus (SLE), ulcerative colitis, and uveitis.
67. The method of clause 66, wherein the disease is selected from: generalized pustular psoriasis (GPP), palmoplantar pustular psoriasis (PPP), and psoriasis.
68. A method of treating psoriasis in a subject, the method comprising administering to the subject a therapeutically effective amount of an antibody of any one of clauses 1-49, or a therapeutically effective amount of a pharmaceutical composition of clause 62.
69. A method of treating cancer in a subject, the method comprising administering to the subject a therapeutically effective amount of an antibody of any one of clauses 1-49, or a therapeutically effective amount of a pharmaceutical composition of clause 62; optionally, wherein the cancer is selected from breast cancer, colorectal cancer, non-small cell lung cancer, pancreatic cancer.

While the foregoing disclosure of the present invention has been described in some detail by way of example and illustration for purposes of clarity and understanding, this disclosure including the examples, descriptions, and embodiments described herein are for illustrative purposes, are intended to be exemplary, and should not be construed as limiting the present disclosure. It will be clear to one skilled in the art that various modifications or changes to the examples, descriptions, and embodiments described herein can be made and are to be included within the spirit and purview of this disclosure and the appended claims. Further, one of skill in the art will recognize a number of equivalent methods and procedure to those described herein. All such equivalents are to be understood to be within the scope of the present disclosure and are covered by the appended claims.

Additional embodiments of the invention are set forth in the following claims.

The disclosures of all publications, patent applications, patents, or other documents mentioned herein are expressly incorporated by reference in their entirety for all purposes to the same extent as if each such individual publication, patent, patent application or other document were individually specifically indicated to be incorporated by reference herein in its entirety for all purposes and were set forth in its entirety herein. In case of conflict, the present specification, including specified terms, will control.

BIBLIOGRAPHY

Towne et al., (2011) "Interleukin-36 (IL-36) ligands require processing for full agonist (IL-36α, IL-36β, and IL-36γ) or antagonist (IL-36Ra) activity." J. Biol. Chem. 284: 42594-42602

Foote et al., (1992) "Antibody framework residues affecting the conformation of the hypervariable loops" J. Mol. Biol. 224: 487-499

Hotzel et al., (2012) "A strategy for risk mitigation of antibodies with fast clearance" mAbs 4(6): 753-760

Brenner et al., (1992) "Encoded combinatorial chemistry" Proc. Natl. Acad. Sci. USA 89(12): 5381-5383

Kunkel et al., (1987) "Rapid and efficient site-specific mutagenesis without phenotypic selection" Methods Enzymol. 154: 367-382

Masella et al., (2012) "PANDAseq: paired-end assembler for illumina sequences" BMC Bioinformatics 13:31

Koenig et al., (2015) "Mutational landscape of antibody variable domains reveals a switch modulating the interdomain conformational dynamics and antigen binding" J. Biol. Chem. 290(36): 21773-21786

John B. B. Ridgway et al., (1996) "'Knobs-into-holes' engineering of antibody CH3 domains for heavy chain heterodimerization" Protein Engineering vol. 9 no. 7 pp. 617-621

SEQUENCE LISTING (751 sequences)

SEQ ID NO: 1 - protein, 153 aa, artificial
  Synthetic polypeptide
KIDTPQQGSIQDINHRVWVLQDQTLIAVPRKDRMSPVTIALISCRHVETLEKDRGNPIYLGLNGLNLCLMCAKVGDQPTLQLKEKDIMDLYNQPEPVKSFLFYHSQSGRNSTFESVAFPGWFIAVSSEGGCPLILTQELGKANTTDFGLTMLF

SEQ ID NO: 2 - protein, 153 aa, artificial
  Synthetic polypeptide
REAAPKSYAIRDSRQMVWVLSGNSLIAAPLSRSIKPVTLHLIACRDTEFSDKEKGNMVYLGIKGKDLCLFCAEIQGKPTLQLKEKNIMDLYVEKKAQKPFLFFHNKEGSTSVFQSVSYPGWFIATSTTSGQPIFLTKERGITNNTNFYLDSVE

SEQ ID NO: 3 - protein, 152 aa, artificial
  Synthetic polypeptide
SMCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 4 - protein, 154 aa, artificial
  Synthetic polypeptide
VLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 5 - protein, 153 aa, artificial
  Synthetic polypeptide
KSEMPQPVSIQDINHRVWVLQDQILIAVPRKDRVSPVTISLISCRHVETLEKDRGNPIYLGLNGLNLCLMCAKAGDQPTLQLKEKDIMDLYNQPEPVKSFLFYHSQSGRNSTFESVAFPGWFIAVSSEGGCPLILTQELGKANTTDFGLTMLF

SEQ ID NO: 6 - protein, 153 aa, artificial
  Synthetic polypeptide
WQAAPKSYAIRDSRQMVWVLSGNSLIAAPLSNRVKPVTLHLITCRDTEFSDKKKGNLVYLGIRGKDLCLFCEEIQGKPTLQLKEKNIMDLYMEKKAQKPFLFFHNKEGSSSVFQSVSYPGWFIATSSTSGQPIFLTQERGITNNTNFYLDSVE

SEQ ID NO: 7 - protein, 151 aa, artificial
  Synthetic polypeptide
SMRTPITGTINDLNQQVWTLQGQILVAVPRSDSVTPVTVAVITCKYPEALDQSRGDPIYLGIRNPEMCLCCEEVGGQPTLQLKEQKIMDLYGQPEPVKPFLFYRVKTGRTSTLESVAFPNWFIASSTRDQPIILTSELGKSYNTAFELNIK

SEQ ID NO: 8 - protein, 111 aa, artificial
  Synthetic polypeptide
MHHHHHHHHHHHHMSDSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGG

SEQ ID NO: 9 - protein, 20 aa, artificial
  Synthetic polypeptide
MHHHHHHHHHHHHENLYFQS

SEQ ID NO: 10 - protein, 20 aa, artificial
  Synthetic polypeptide
GGGGSGLNDIFEAQKIEWHE

SEQ ID NO: 11 - protein, 19 aa, artificial
  Synthetic polypeptide
MGWSCIILFLVATATGVHS

SEQ ID NO: 12 - protein, 257 aa, artificial
  Synthetic polypeptide
SGGGGSENLYFQGGGGSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKDYKDDDDK

SEQ ID NO: 13 - protein, 111 aa, artificial
  Synthetic polypeptide
QSVLTQPPSVSGAPGQRVTISCTGSSSNIGAHYDVHWYQQLPGTAPKLLIYSNNNRPSGVPDRFSGSKSGTSASLAITGLQAEDEADYYCQSYDYSLRGYVFGGGTKLTVL

SEQ ID NO: 14 - protein, 14 aa, artificial
  Synthetic polypeptide
TGSSSNIGAHYDVH

SEQ ID NO: 15 - protein, 7 aa, artificial
  Synthetic polypeptide
SNNNRPS

SEQ ID NO: 16 - protein, 11 aa, artificial
  Synthetic polypeptide
QSYDYSLRGYV

SEQ ID NO: 17 - protein, 111 aa, artificial
  Synthetic polypeptide
QSVLTQPPSVSGAPGQRVTISCTGSSSNIGAHYDVHWYQQLPGTAPKLLIYGNDNRPSGVPDRFSGSKSGTSASLAITGLQAEDEADYYCQSYDYSLSGYVFGGGTKLTVL

SEQ ID NO: 18 - protein, 14 aa, artificial
  Synthetic polypeptide
TGSSSNIGAHYDVH

SEQ ID NO: 19 - protein, 7 aa, artificial
  Synthetic polypeptide
GNDNRPS

SEQ ID NO: 20 - protein, 11 aa, artificial
  Synthetic polypeptide
QSYDYSLSGYV

SEQ ID NO: 21 - protein, 111 aa, artificial
  Synthetic polypeptide
QSVLTQPPSVSGAPGQRVTISCTGSSSNIGAGYDVHWYQQLPGTAPKLLIYGNTNRPSGVPDRFSGSKSGTSASLAITGLQAEDEADYYCQSYDYSLRGYVFGGGTKLTVL

SEQ ID NO: 22 - protein, 14 aa, artificial
  Synthetic polypeptide
TGSSSNIGAGYDVH

SEQ ID NO: 23 - protein, 7 aa, artificial
  Synthetic polypeptide
GNTNRPS

SEQ ID NO: 24 - protein, 11 aa, artificial
  Synthetic polypeptide
QSYDYSLRGYV

SEQ ID NO: 25 - protein, 111 aa, artificial
  Synthetic polypeptide
QSVLTQPPSVSGAPGQRVTISCTGSSSNIGAGYDVHWYQQLPGTAPKLLIYGNRNRPSGVPDRFSGSKSGTSASLAITGLQAEDEADYYCQSYDYSLRVYVFGGGTKLTVL

SEQ ID NO: 26 - protein, 14 aa, artificial
  Synthetic polypeptide
TGSSSNIGAGYDVH

SEQ ID NO: 27 - protein, 7 aa, artificial
  Synthetic polypeptide
GNRNRPS

SEQ ID NO: 28 - protein, 11 aa, artificial
  Synthetic polypeptide
QSYDYSLRVYV

SEQ ID NO: 29 - protein, 111 aa, artificial
  Synthetic polypeptide
QSVLTQPPSVSGAPGQRVTISCTGSSSNIGAHYDVHWYQQLPGTAPKLLIYGNDNRPSGVPDRFSGSKSGTSASLAITGLQAEDEADYYCQSYDYSLKAYVFGGGTKLTVL

SEQ ID NO: 30 - protein, 14 aa, artificial
  Synthetic polypeptide
TGSSSNIGAGYDVH

SEQ ID NO: 31 - protein, 7 aa, artificial
  Synthetic polypeptide
GNDNRPS

SEQ ID NO: 32 - protein, 11 aa, artificial
  Synthetic polypeptide
QSYDYSLKAYV

SEQ ID NO: 33 - protein, 111 aa, artificial
  Synthetic polypeptide
QSVLTQPPSVSGAPGQRVTISCTGSSSNIGAGYDVHWYQQLPGTAPKLLIYGNTNRPSGVPDRFSGSKSGTSASLAITGLQAEDEADYYCQSYDISLSGWVFGGGTKLTVL

SEQ ID NO: 34 - protein, 14 aa, artificial
  Synthetic polypeptide
TGSSSNIGAGYDVH

SEQ ID NO: 35 - protein, 7 aa, artificial
  Synthetic polypeptide
GNTNRPS

SEQ ID NO: 36 - protein, 11 aa, artificial
  Synthetic polypeptide
QSYDISLSGWV

SEQ ID NO: 37 - protein, 108 aa, artificial
  Synthetic polypeptide
EIVLTQSPGTLSLSPGERATLSCRASQSVSSNYLAWYQQKPGQAPKLLIYSASSLQSGVPSRFSGSGSGTDFTLTISSLQPEDFATYYCQQTYSYPPTFGQGTKVEIK

SEQ ID NO: 38 - protein, 12 aa, artificial
  Synthetic polypeptide
RASQSVSSNYLA

SEQ ID NO: 39 - protein, 7 aa, artificial
  Synthetic polypeptide
SASSLQS

SEQ ID NO: 40 - protein, 9 aa, artificial
  Synthetic polypeptide
QQTYSYPPT

SEQ ID NO: 41 - protein, 107 aa, artificial
  Synthetic polypeptide
DIQMTQSPSSLSASVGDRVTITCRASQTIYKYLNWYQQKPGKAPKLLIYAASSLQSGVPSRFSGSGSGTDFTLTISSLQPEDFATYYCQQYSSIPYTFGQGTKVEIK

SEQ ID NO: 42 - protein, 11 aa, artificial
  Synthetic polypeptide
RASQTIYKYLN

SEQ ID NO: 43 - protein, 7 aa, artificial
  Synthetic polypeptide
AASSLQS

SEQ ID NO: 44 - protein, 9 aa, artificial
  Synthetic polypeptide
QQYSSIPYT

SEQ ID NO: 45 - protein, 120 aa, artificial
  Synthetic polypeptide
QVQLVESGGGVVQPGRSLRLSCAASGFSFSAYAMHWVRQAPGKGLEWVAVISYDGTNEYYADSVKGRFTISRDNSKNTLYLQMNSLRAEDTAVYYCARGIRIFTSYFDSWGQGTLVTVSS

SEQ ID NO: 46 - protein, 7 aa, artificial
  Synthetic polypeptide
SAYAMHW

SEQ ID NO: 47 - protein, 13 aa, artificial
  Synthetic polypeptide
VISYDGTNEYYAD

SEQ ID NO: 48 - protein, 13 aa, artificial
  Synthetic polypeptide
ARGIRIFTSYFDS

SEQ ID NO: 49 - protein, 123 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSS

SEQ ID NO: 50 - protein, 7 aa, artificial
  Synthetic polypeptide
STSSYYW

SEQ ID NO: 51 - protein, 12 aa, artificial
  Synthetic polypeptide
SIYYTGNTYYNP

SEQ ID NO: 52 - protein, 15 aa, artificial
  Synthetic polypeptide
ARVRYGVGVPRYFDP

SEQ ID NO: 53 - protein, 123 aa, artificial
  Synthetic polypeptide
QLQLQESGPGLVKPSETLSLTCTVSGGSISSTSYYWGWIRQPPGKGLEWIGSIHYSGNTYYNPSLKSRVTISVDTSKNQFSLKLSSVTAADTAVYYCARVHYGGYIPRRFDHWGQGTLVTVSS

SEQ ID NO: 54 - protein, 7 aa, artificial
  Synthetic polypeptide
SSTSYYW

SEQ ID NO: 55 - protein, 12 aa, artificial
  Synthetic polypeptide
SIHYSGNTYYNP

SEQ ID NO: 56 - protein, 15 aa, artificial
  Synthetic polypeptide
ARVHYGGYIPRRFDH

SEQ ID NO: 57 - protein, 121 aa, artificial
  Synthetic polypeptide
QLQLQESGPGLVKPSETLSLTCTVSGGSIGSRSYYWGWIRQPPGKGLEWIGSIHYSGTTYYNPSLKSRVTISVDTSKNQFSLKLSSVTAADTAVYYCARVAPSYPRVFDYWGQGTLVTVSS

SEQ ID NO: 58 - protein, 7 aa, artificial
  Synthetic polypeptide
GSRSYYW

SEQ ID NO: 59 - protein, 12 aa, artificial
  Synthetic polypeptide
SIHYSGTTYYNP

SEQ ID NO: 60 - protein, 13 aa, artificial
  Synthetic polypeptide
ARVAPSYPRVFDY

SEQ ID NO: 61 - protein, 122 aa, artificial
  Synthetic polypeptide
EVQLLESGGGLVQPGGSLRLSCAASGFTFSTYAMSWVRQAPGKGLEWVSGISGGSGYTYYADSVKGRFTISRDNSKNTLYLQMNSLRAEDTAVYYCARVVTYRDPPASFDYWGQGTLVTVSS

SEQ ID NO: 62 - protein, 6 aa, artificial
  Synthetic polypeptide
STYAMS

SEQ ID NO: 63 - protein, 13 aa, artificial
  Synthetic polypeptide
GISGGSGYTYYAD

SEQ ID NO: 64 - protein, 15 aa, artificial
  Synthetic polypeptide
ARVVTYRDPPASFDY

SEQ ID NO: 65 - protein, 122 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSS

SEQ ID NO: 66 - protein, 7 aa, artificial
  Synthetic polypeptide
TSSNYYW

SEQ ID NO: 67 - protein, 12 aa, artificial
  Synthetic polypeptide
SIDYTGSTYYNP

SEQ ID NO: 68 - protein, 14 aa, artificial
  Synthetic polypeptide
ARGKYYETYLGFDV

SEQ ID NO: 69 - protein, 125 aa, artificial
  Synthetic polypeptide
QVQLVESGGGVVQPGRSLRLSCAASGFTFSSYGMHWVRQAPGKGLEWVAVISYGGSERYYADSVKGRFTISRDNSKNTLYLQMNSLRAEDTAVYYCAREPWYSSRGWTGYGFDVWGQGTLVTVSS

SEQ ID NO: 70 - protein, 6 aa, artificial
  Synthetic polypeptide
SSYGMH

SEQ ID NO: 71 - protein, 13 aa, artificial
  Synthetic polypeptide
VISYGGSERYYAD

SEQ ID NO: 72 - protein, 18 aa, artificial
  Synthetic polypeptide
AREPWYSSRGWTGYGFDV

SEQ ID NO: 73 - protein, 120 aa, artificial
  Synthetic polypeptide
QVQLVQSGAEVKKPGSSVKVSCKASGGTFSNYAISWVRQAPGQGLEWMGGILPILGTVDYAQKFQGRVTITADESTSTAYMELSSLRSEDTAVYYCAREPWYRLGAFDVWGQGTLVTVSS

SEQ ID NO: 74 - protein, 6 aa, artificial
  Synthetic polypeptide
SNYAIS

SEQ ID NO: 75 - protein, 13 aa, artificial
  Synthetic polypeptide
GILPILGTVDYAQ

SEQ ID NO: 76 - protein, 13 aa, artificial
  Synthetic polypeptide
AREPWYRLGAFDV

SEQ ID NO: 77 - protein, 111 aa, artificial
  Synthetic polypeptide
ESVLTQPPSVSGAPGQRVTISCTGSSSNIGAHYDVHWYQQLPGTAPKLLIYGNDNRPSGVPDRFSGSKSGTSASLAITGLQAEDEADYYCQSYDYSLSGYVFGGGTKLTVL

SEQ ID NO: 78 - protein, 111 aa, artificial
  Synthetic polypeptide
ESVLTQPPSVSGAPGQRVTISCTGSSSNIGAGYDVHWYQQLPGTAPKLLIYGNTNRPSGVPDRFSGSKSGTSASLAITGLQAEDEADYYCQSYDISLSGWVFGGGTKLTVL

SEQ ID NO: 79 - protein, 123 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSS

SEQ ID NO: 80 - protein, 122 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSS

SEQ ID NO: 81 - protein, 122 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSS

SEQ ID NO: 82 - protein, 7 aa, artificial
  Synthetic polypeptide
TSTNYYW

SEQ ID NO: 83 - protein, 12 aa, artificial
  Synthetic polypeptide
NIDYTGSTYYNA

SEQ ID NO: 84 - protein, 14 aa, artificial
  Synthetic polypeptide
ATGKYYETYLGFDV

SEQ ID NO: 85 - protein, 122 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSS

SEQ ID NO: 86 - protein, 7 aa, artificial
  Synthetic polypeptide
TSSNAYW

SEQ ID NO: 87 - protein, 12 aa, artificial
  Synthetic polypeptide
SIDYTGSTAYNP

SEQ ID NO: 88 - protein, 14 aa, artificial
  Synthetic polypeptide
AHGKYYETYLGFDV

SEQ ID NO: 89 - protein, 122 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSS

SEQ ID NO: 90 - protein, 7 aa, artificial
  Synthetic polypeptide
TASNYYW

SEQ ID NO: 91 - protein, 12 aa, artificial
  Synthetic polypeptide
SIDYTGSTYYNT

SEQ ID NO: 92 - protein, 14 aa, artificial
  Synthetic polypeptide
ATGKYYETYLGFDV

SEQ ID NO: 93 - protein, 122 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSS

SEQ ID NO: 94 - protein, 7 aa, artificial
  Synthetic polypeptide
TASNYYW

SEQ ID NO: 95 - protein, 12 aa, artificial
  Synthetic polypeptide
SIDYTGSTYYNP

SEQ ID NO: 96 - protein, 14 aa, artificial
  Synthetic polypeptide
ATGKYYETYLGFDV

SEQ ID NO: 97 - protein, 122 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSS

SEQ ID NO: 98 - protein, 7 aa, artificial
  Synthetic polypeptide
TASNYYW

SEQ ID NO: 99 - protein, 12 aa, artificial
  Synthetic polypeptide
SIDYTGSTYYEP

SEQ ID NO: 100 - protein, 14 aa, artificial
  Synthetic polypeptide
ATGSYYETYLGFDV

SEQ ID NO: 101 - protein, 122 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSS

SEQ ID NO: 102 - protein, 7 aa, artificial
  Synthetic polypeptide
TASNYYW

SEQ ID NO: 103 - protein, 12 aa, artificial
  Synthetic polypeptide
SIDYTGSTYYEP

SEQ ID NO: 104 - protein, 14 aa, artificial
  Synthetic polypeptide
ATGNYYETYLGFDV

SEQ ID NO: 105 - protein, 122 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSS

SEQ ID NO: 106 - protein, 7 aa, artificial
  Synthetic polypeptide
TASNTYW

SEQ ID NO: 107 - protein, 12 aa, artificial
  Synthetic polypeptide
SIDYTGSTYYNP

SEQ ID NO: 108 - protein, 14 aa, artificial
  Synthetic polypeptide
ATGKYYETYLGFDV

SEQ ID NO: 109 - protein, 122 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSS

SEQ ID NO: 110 - protein, 7 aa, artificial
  Synthetic polypeptide
TASNYYW

SEQ ID NO: 111 - protein, 12 aa, artificial
  Synthetic polypeptide
SIDYTGSTYYNP

SEQ ID NO: 112 - protein, 14 aa, artificial
  Synthetic polypeptide
ASGKYYETYLGFDV

SEQ ID NO: 113 - protein, 122 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSS

SEQ ID NO: 114 - protein, 7 aa, artificial
  Synthetic polypeptide
TSSNYYW

SEQ ID NO: 115 - protein, 12 aa, artificial
  Synthetic polypeptide
SIDYTGSTYYNP

SEQ ID NO: 116 - protein, 14 aa, artificial
  Synthetic polypeptide
ATGKYYETYLGFDV

SEQ ID NO: 117 - protein, 122 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSS

SEQ ID NO: 118 - protein, 7 aa, artificial
  Synthetic polypeptide
TSSNYYW

SEQ ID NO: 119 - protein, 12 aa, artificial
  Synthetic polypeptide
SIDYTGSTYYQP

SEQ ID NO: 120 - protein, 14 aa, artificial
  Synthetic polypeptide
ARGNYYETYLGFDV

SEQ ID NO: 121 - protein, 123 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSS

SEQ ID NO: 122 - protein, 7 aa, artificial
  Synthetic polypeptide
SDSSYYW

SEQ ID NO: 123 - protein, 12 aa, artificial
  Synthetic polypeptide
SIYYTGNTYYNS

SEQ ID NO: 124 - protein, 15 aa, artificial
  Synthetic polypeptide
ARVRYGVGVPRYFDP

SEQ ID NO: 125 - protein, 123 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSS

SEQ ID NO: 126 - protein, 7 aa, artificial
  Synthetic polypeptide
SESSYYW

SEQ ID NO: 127 - protein, 12 aa, artificial
  Synthetic polypeptide
SIYYTGNTYYNP

SEQ ID NO: 128 - protein, 15 aa, artificial
  Synthetic polypeptide
AGVRYGVGVPRYFDP

SEQ ID NO: 129 - protein, 123 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSS

SEQ ID NO: 130 - protein, 7 aa, artificial
  Synthetic polypeptide
STSSDYW

SEQ ID NO: 131 - protein, 12 aa, artificial
  Synthetic polypeptide
SIYYTGNTYYLP

SEQ ID NO: 132 - protein, 15 aa, artificial
  Synthetic polypeptide
SRVRYGVGVPRYFDP

SEQ ID NO: 133 - protein, 123 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSS

SEQ ID NO: 134 - protein, 7 aa, artificial
  Synthetic polypeptide
SNSSYYW

SEQ ID NO: 135 - protein, 12 aa, artificial
  Synthetic polypeptide
SIYYTGNTYYLP

SEQ ID NO: 136 - protein, 15 aa, artificial
  Synthetic polypeptide
ARVRYGVGVPRYFDP

SEQ ID NO: 137 - protein, 123 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSS

SEQ ID NO: 138 - protein, 7 aa, artificial
  Synthetic polypeptide
SESSYYW

SEQ ID NO: 139 - protein, 12 aa, artificial
  Synthetic polypeptide
SIYYTGNTYYLP

SEQ ID NO: 140 - protein, 15 aa, artificial
  Synthetic polypeptide
ARVRYGVGVPRYFDP

SEQ ID NO: 141 - protein, 123 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSS

SEQ ID NO: 142 - protein, 7 aa, artificial
  Synthetic polypeptide
STSSYHW

SEQ ID NO: 143 - protein, 12 aa, artificial
  Synthetic polypeptide
SIYYTGNTYYMP

SEQ ID NO: 144 - protein, 15 aa, artificial
  Synthetic polypeptide
VRVRYGVGVPRYFDP

SEQ ID NO: 145 - protein, 123 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSS

SEQ ID NO: 146 - protein, 7 aa, artificial
  Synthetic polypeptide
SRSSYYW

SEQ ID NO: 147 - protein, 12 aa, artificial
  Synthetic polypeptide
SIYYTGNTYYWP

SEQ ID NO: 148 - protein, 15 aa, artificial
  Synthetic polypeptide
TRVRYGVGVPRYFDP

SEQ ID NO: 149 - protein, 123 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSS

SEQ ID NO: 150 - protein, 7 aa, artificial
  Synthetic polypeptide
SDSSYYW

SEQ ID NO: 151 - protein, 12 aa, artificial
  Synthetic polypeptide
SIYYTGETYYAP

SEQ ID NO: 152 - protein, 15 aa, artificial
  Synthetic polypeptide
ARLRYGVGVPRYFDP

SEQ ID NO: 153 - protein, 123 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSS

SEQ ID NO: 154 - protein, 7 aa, artificial
  Synthetic polypeptide
SDSSYYW

SEQ ID NO: 155 - protein, 12 aa, artificial
  Synthetic polypeptide
SIYYTGETYYAP

SEQ ID NO: 156 - protein, 15 aa, artificial
  Synthetic polypeptide
ARVKYGVGVPRYFDP

SEQ ID NO: 157 - protein, 123 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSS

SEQ ID NO: 158 - protein, 7 aa, artificial
  Synthetic polypeptide
SDSSYYW

SEQ ID NO: 159 - protein, 12 aa, artificial
  Synthetic polypeptide
SIYYTGETYYAP

SEQ ID NO: 160 - protein, 15 aa, artificial
  Synthetic polypeptide
ARVRYGVGVPRHFDP

SEQ ID NO: 161 - protein, 123 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSS

SEQ ID NO: 162 - protein, 7 aa, artificial
  Synthetic polypeptide
SESSYYW

SEQ ID NO: 163 - protein, 12 aa, artificial
  Synthetic polypeptide
SIYYTGETYYAP

SEQ ID NO: 164 - protein, 15 aa, artificial
  Synthetic polypeptide
ARLRYGVGVPRYFDP

SEQ ID NO: 165 - protein, 123 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSS

SEQ ID NO: 166 - protein, 7 aa, artificial
  Synthetic polypeptide
SESSYYW

SEQ ID NO: 167 - protein, 12 aa, artificial
  Synthetic polypeptide
SIYYTGETYYAP

SEQ ID NO: 168 - protein, 15 aa, artificial
  Synthetic polypeptide
ARVKYGVGVPRYFDP

SEQ ID NO: 169 - protein, 217 aa, artificial
  Synthetic polypeptide
ESVLTQPPSVSGAPGQRVTISCTGSSSNIGAHYDVHWYQQLPGTAPKLLIYGNDNRPSGVPDRFSGSKSGTSASLAITGLQAEDEADYYCQSYDYSLSGYVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 170 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 171 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 172 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 173 - protein, 451 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 174 - protein, 451 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 175 - protein, 451 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 176 - protein, 451 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 177 - protein, 451 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 178 - protein, 451 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 179 - protein, 451 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 180 - protein, 451 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 181 - protein, 451 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 182 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 183 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 184 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 185 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 186 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 187 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 188 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 189 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 190 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 191 - protein, 451 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 192 - protein, 451 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 193 - protein, 451 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 194 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 195 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 196 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 197 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 198 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 199 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 200 - protein, 451 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 201 - protein, 451 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 202 - protein, 451 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 203 - protein, 452 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 204 - protein, 452 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 205 - protein, 452 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 206 - protein, 452 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 207 - protein, 452 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 452 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 209 - protein, 452 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 210 - protein, 452 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 211 - protein, 452 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 212 - protein, 452 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 213 - protein, 452 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 214 - protein, 452 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 215 - protein, 452 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 216 - protein, 452 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 217 - protein, 452 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 218 - protein, 452 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 219 - protein, 452 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 220 - protein, 452 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 221 - protein, 452 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 222 - protein, 452 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 223 - protein, 452 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 224 - protein, 452 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 225 - protein, 452 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - protein, 452 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 227 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 228 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 229 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 230 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 231 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 232 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 233 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 234 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 235 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 236 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 237 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 238 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 239 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 240 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 241 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 242 - protein, 217 aa, artificial
  Synthetic polypeptide
ESVLTQPPSVSGAPGQRVTISCTGSSSNIGAGYDVHWYQQLPGTAPKLLIYGNTNRPSGVPDRFSGSKSGTSASLAITGLQAEDEADYYCQSYDISLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 243 - protein, 452 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 244 - protein, 452 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 245 - protein, 452 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 246 - protein, 217 aa, artificial
  Synthetic polypeptide
QSVLTQPPSVSGAPGQRVTISCTGSSSNIGAHYDVHWYQQLPGTAPKLLIYGNDNRPSGVPDRFSGSKSGTSASLAITGLQAEDEADYYCQSYDYSLSGYVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 247 - protein, 218 aa, artificial
  Synthetic polypeptide
QESVLTQPPSVSGAPGQRVTISCTGSSSNIGAGYDVHWYQQLPGTAPKLLIYGNTNRPSGVPDRFSGSKSGTSASLAITGLQAEDEADYYCQSYDISLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 248 - protein, 451 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 249 - protein, 451 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 250 - protein, 451 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 251 - protein, 7 aa, artificial
  Synthetic polypeptide
  VARIANT (1)..(1): X at 1 is T, D, E, or N.
  VARIANT (2)..(2): X at 2 is S, A, E, G, K, Q, R, or T.
  VARIANT (3)..(3): X at 3 is S, A, D, E, G, N, P, Q, or T.
  VARIANT (5)..(5): X at 5 is Y, A, E, G, H, M, N, Q, S, T, or V.
  VARIANT (7)..(7): X at 7 is W, F, I, V, or Y.
XXXNXYX

SEQ ID NO: 252 - protein, 7 aa, artificial
  Synthetic polypeptide
DSSNYYW

SEQ ID NO: 253 - protein, 7 aa, artificial
  Synthetic polypeptide
ESSNYYW

SEQ ID NO: 254 - protein, 7 aa, artificial
  Synthetic polypeptide
NSSNYYW

SEQ ID NO: 255 - protein, 7 aa, artificial
  Synthetic polypeptide
TASNYYW

SEQ ID NO: 256 - protein, 7 aa, artificial
  Synthetic polypeptide
TESNYYW

SEQ ID NO: 257 - protein, 7 aa, artificial
  Synthetic polypeptide
TGSNYYW

SEQ ID NO: 258 - protein, 7 aa, artificial
  Synthetic polypeptide
TKSNYYW

SEQ ID NO: 259 - protein, 7 aa, artificial
  Synthetic polypeptide
TQSNYYW

SEQ ID NO: 260 - protein, 7 aa, artificial
  Synthetic polypeptide
TRSNYYW

SEQ ID NO: 261 - protein, 7 aa, artificial
  Synthetic polypeptide
TTSNYYW

SEQ ID NO: 262 - protein, 7 aa, artificial
  Synthetic polypeptide
TSANYYW

SEQ ID NO: 263 - protein, 7 aa, artificial
  Synthetic polypeptide
TSDNYYW

SEQ ID NO: 264 - protein, 7 aa, artificial
  Synthetic polypeptide
TSENYYW

SEQ ID NO: 265 - protein, 7 aa, artificial
  Synthetic polypeptide
TSGNYYW

SEQ ID NO: 266 - protein, 7 aa, artificial
  Synthetic polypeptide
TSNNYYW

SEQ ID NO: 267 - protein, 7 aa, artificial
  Synthetic polypeptide
TSPNYYW

SEQ ID NO: 268 - protein, 7 aa, artificial
  Synthetic polypeptide
TSQNYYW

SEQ ID NO: 269 - protein, 7 aa, artificial
  Synthetic polypeptide
TSTNYYW

SEQ ID NO: 270 - protein, 7 aa, artificial
  Synthetic polypeptide
TSSNAYW

SEQ ID NO: 271 - protein, 7 aa, artificial
  Synthetic polypeptide
TSSNEYW

SEQ ID NO: 272 - protein, 7 aa, artificial
  Synthetic polypeptide
TSSNGYW

SEQ ID NO: 273 - protein, 7 aa, artificial
  Synthetic polypeptide
TSSNHYW

SEQ ID NO: 274 - protein, 7 aa, artificial
  Synthetic polypeptide
TSSNMYW

SEQ ID NO: 275 - protein, 7 aa, artificial
  Synthetic polypeptide
TSSNNYW

SEQ ID NO: 276 - protein, 7 aa, artificial
  Synthetic polypeptide
TSSNQYW

SEQ ID NO: 277 - protein, 7 aa, artificial
  Synthetic polypeptide
TSSNSYW

SEQ ID NO: 278 - protein, 7 aa, artificial
  Synthetic polypeptide
TSSNTYW

SEQ ID NO: 279 - protein, 7 aa, artificial
  Synthetic polypeptide
TSSNVYW

SEQ ID NO: 280 - protein, 7 aa, artificial
  Synthetic polypeptide
TSSNYYF

SEQ ID NO: 281 - protein, 7 aa, artificial
  Synthetic polypeptide
TSSNYYI

SEQ ID NO: 282 - protein, 7 aa, artificial
  Synthetic polypeptide
TSSNYYV

SEQ ID NO: 283 - protein, 7 aa, artificial
  Synthetic polypeptide
TSSNYYY

SEQ ID NO: 284 - protein, 12 aa, artificial
  Synthetic polypeptide
  VARIANT (1)..(1): X at 1 is S, N, or T.
  VARIANT (2)..(2): X at 2 is I, M, or V.
  VARIANT (4)..(4): X at 4 is Y, or H.
  VARIANT (5)..(5): X at 5 is T, H, L, or N.
  VARIANT (6)..(6): X at 6 is G, A, D, E, H, K, N, Q, R, S, or T.
  VARIANT (7)..(7): X at 7 is S, A, D, Q, or T.
  VARIANT (8)..(8): X at 8 is T, A, D, or E.
  VARIANT (9)..(9): X at 9 is Y, A, F, Q, S, or W.
  VARIANT (11)..(11): X at 11 is N, D, E, H, P, or Q.
  VARIANT (12)..(12): X at 12 is P, A, or E.
XXDXXXXXXYXX

SEQ ID NO: 285 - protein, 12 aa, artificial
  Synthetic polypeptide
NIDYTGSTYYNP

SEQ ID NO: 286 - protein, 12 aa, artificial
  Synthetic polypeptide
TIDYTGSTYYNP

SEQ ID NO: 287 - protein, 12 aa, artificial
  Synthetic polypeptide
SMDYTGSTYYNP

SEQ ID NO: 288 - protein, 12 aa, artificial
  Synthetic polypeptide
SVDYTGSTYYNP

SEQ ID NO: 289 - protein, 12 aa, artificial
  Synthetic polypeptide
SIDHTGSTYYNP

SEQ ID NO: 290 - protein, 12 aa, artificial
  Synthetic polypeptide
SIDYHGSTYYNP

SEQ ID NO: 291 - protein, 12 aa, artificial
  Synthetic polypeptide
SIDYLGSTYYNP

SEQ ID NO: 292 - protein, 12 aa, artificial
  Synthetic polypeptide
SIDYNGSTYYNP

SEQ ID NO: 293 - protein, 12 aa, artificial
  Synthetic polypeptide
SIDYTASTYYNP

SEQ ID NO: 294 - protein, 12 aa, artificial
  Synthetic polypeptide
SIDYTDSTYYNP

SEQ ID NO: 295 - protein, 12 aa, artificial
  Synthetic polypeptide
SIDYTESTYYNP

SEQ ID NO: 296 - protein, 12 aa, artificial
  Synthetic polypeptide
SIDYTHSTYYNP

SEQ ID NO: 297 - protein, 12 aa, artificial
  Synthetic polypeptide
SIDYTKSTYYNP

SEQ ID NO: 298 - protein, 12 aa, artificial
  Synthetic polypeptide
SIDYTNSTYYNP

SEQ ID NO: 299 - protein, 12 aa, artificial
  Synthetic polypeptide
SIDYTQSTYYNP

SEQ ID NO: 300 - protein, 12 aa, artificial
  Synthetic polypeptide
SIDYTRSTYYNP

SEQ ID NO: 301 - protein, 12 aa, artificial
  Synthetic polypeptide
SIDYTSSTYYNP

SEQ ID NO: 302 - protein, 12 aa, artificial
  Synthetic polypeptide
SIDYTTSTYYNP

SEQ ID NO: 303 - protein, 12 aa, artificial
  Synthetic polypeptide
SIDYTGATYYNP

SEQ ID NO: 304 - protein, 12 aa, artificial
  Synthetic polypeptide
SIDYTGDTYYNP

SEQ ID NO: 305 - protein, 12 aa, artificial
  Synthetic polypeptide
SIDYTGQTYYNP

SEQ ID NO: 306 - protein, 12 aa, artificial
  Synthetic polypeptide
SIDYTGTTYYNP

SEQ ID NO: 307 - protein, 12 aa, artificial
  Synthetic polypeptide
SIDYTGSAYYNP

SEQ ID NO: 308 - protein, 12 aa, artificial
  Synthetic polypeptide
SIDYTGSDYYNP

SEQ ID NO: 309 - protein, 12 aa, artificial
  Synthetic polypeptide
SIDYTGSEYYNP

SEQ ID NO: 310 - protein, 12 aa, artificial
  Synthetic polypeptide
SIDYTGSTAYNP

SEQ ID NO: 311 - protein, 12 aa, artificial
  Synthetic polypeptide
SIDYTGSTFYNP

SEQ ID NO: 312 - protein, 12 aa, artificial
  Synthetic polypeptide
SIDYTGSTQYNP

SEQ ID NO: 313 - protein, 12 aa, artificial
  Synthetic polypeptide
SIDYTGSTSYNP

SEQ ID NO: 314 - protein, 12 aa, artificial
  Synthetic polypeptide
SIDYTGSTWYNP

SEQ ID NO: 315 - protein, 12 aa, artificial
  Synthetic polypeptide
SIDYTGSTYYDP

SEQ ID NO: 316 - protein, 12 aa, artificial
  Synthetic polypeptide
SIDYTGSTYYEP

SEQ ID NO: 317 - protein, 12 aa, artificial
  Synthetic polypeptide
SIDYTGSTYYHP

SEQ ID NO: 318 - protein, 12 aa, artificial
  Synthetic polypeptide
SIDYTGSTYYPP

SEQ ID NO: 319 - protein, 12 aa, artificial
  Synthetic polypeptide
SIDYTGSTYYQP

SEQ ID NO: 320 - protein, 12 aa, artificial
  Synthetic polypeptide
SIDYTGSTYYNA

SEQ ID NO: 321 - protein, 12 aa, artificial
  Synthetic polypeptide
SIDYTGSTYYNE

SEQ ID NO: 322 - protein, 14 aa, artificial
  Synthetic polypeptide
  VARIANT (2)..(2): X at 2 is R, A, E, G, H, M, N, Q, S, T, or Y.
  VARIANT (4)..(4): X at 4 is K, A, or S.
  VARIANT (7)..(7): X at 7 is E, or T.
AXGXYYXTYLGFDV

SEQ ID NO: 323 - protein, 14 aa, artificial
  Synthetic polypeptide
AAGKYYETYLGFDV

SEQ ID NO: 324 - protein, 14 aa, artificial
  Synthetic polypeptide
AEGKYYETYLGFDV

SEQ ID NO: 325 - protein, 14 aa, artificial
  Synthetic polypeptide
AGGKYYETYLGFDV

SEQ ID NO: 326 - protein, 14 aa, artificial
  Synthetic polypeptide
AHGKYYETYLGFDV

SEQ ID NO: 327 - protein, 14 aa, artificial
  Synthetic polypeptide
AMGKYYETYLGFDV

SEQ ID NO: 328 - protein, 14 aa, artificial
  Synthetic polypeptide
ANGKYYETYLGFDV

SEQ ID NO: 329 - protein, 14 aa, artificial
  Synthetic polypeptide
AQGKYYETYLGFDV

SEQ ID NO: 330 - protein, 14 aa, artificial
  Synthetic polypeptide
ASGKYYETYLGFDV

SEQ ID NO: 331 - protein, 14 aa, artificial
  Synthetic polypeptide
ATGKYYETYLGFDV

SEQ ID NO: 332 - protein, 14 aa, artificial
  Synthetic polypeptide
AYGKYYETYLGFDV

SEQ ID NO: 333 - protein, 14 aa, artificial
  Synthetic polypeptide
ARGAYYETYLGFDV

SEQ ID NO: 334 - protein, 14 aa, artificial
  Synthetic polypeptide
ARGSYYETYLGFDV

SEQ ID NO: 335 - protein, 14 aa, artificial
  Synthetic polypeptide
ARGKYYTTYLGFDV

SEQ ID NO: 336 - protein, 7 aa, artificial
  Synthetic polypeptide
  VARIANT (1)..(1): X at 1 is S, or D.
  VARIANT (2)..(2): X at 2 is T, A, D, E, G, H, K, N, P, Q, R, or S.
  VARIANT (3)..(3): X at 3 is S, D, E, G, K, N, P, or R.
  VARIANT (4)..(4): X at 4 is S, G, K, N, or P.
  VARIANT (5)..(5): X at 5 is Y, A, D, E, G, H, M, N, Q, S, T, V, or W.
  VARIANT (6)..(6): X at 6 is Y, A, F, G, H, M, N, or Q.
XXXXXXW

SEQ ID NO: 337 - protein, 7 aa, artificial
  Synthetic polypeptide
DTSSYYW

SEQ ID NO: 338 - protein, 7 aa, artificial
  Synthetic polypeptide
SASSYYW

SEQ ID NO: 339 - protein, 7 aa, artificial
  Synthetic polypeptide
SDSSYYW

SEQ ID NO: 340 - protein, 7 aa, artificial
  Synthetic polypeptide
SESSYYW

SEQ ID NO: 341 - protein, 7 aa, artificial
  Synthetic polypeptide
SGSSYYW

SEQ ID NO: 342 - protein, 7 aa, artificial
  Synthetic polypeptide
SHSSYYW

SEQ ID NO: 343 - protein, 7 aa, artificial
  Synthetic polypeptide
SKSSYYW

SEQ ID NO: 344 - protein, 7 aa, artificial
  Synthetic polypeptide
SNSSYYW

SEQ ID NO: 345 - protein, 7 aa, artificial
  Synthetic polypeptide
SPSSYYW

SEQ ID NO: 346 - protein, 7 aa, artificial
  Synthetic polypeptide
SQSSYYW

SEQ ID NO: 347 - protein, 7 aa, artificial
  Synthetic polypeptide
SRSSYYW

SEQ ID NO: 348 - protein, 7 aa, artificial
  Synthetic polypeptide
SSSSYYW

SEQ ID NO: 349 - protein, 7 aa, artificial
  Synthetic polypeptide
STDSYYW

SEQ ID NO: 350 - protein, 7 aa, artificial
  Synthetic polypeptide
STESYYW

SEQ ID NO: 351 - protein, 7 aa, artificial
  Synthetic polypeptide
STGSYYW

SEQ ID NO: 352 - protein, 7 aa, artificial
  Synthetic polypeptide
STKSYYW

SEQ ID NO: 353 - protein, 7 aa, artificial
  Synthetic polypeptide
STNSYYW

SEQ ID NO: 354 - protein, 7 aa, artificial
  Synthetic polypeptide
STPSYYW

SEQ ID NO: 355 - protein, 7 aa, artificial
  Synthetic polypeptide
STRSYYW

SEQ ID NO: 356 - protein, 7 aa, artificial
  Synthetic polypeptide
STSGYYW

SEQ ID NO: 357 - protein, 7 aa, artificial
  Synthetic polypeptide
STSKYYW

SEQ ID NO: 358 - protein, 7 aa, artificial
  Synthetic polypeptide
STSNYYW

SEQ ID NO: 359 - protein, 7 aa, artificial
  Synthetic polypeptide
STSPYYW

SEQ ID NO: 360 - protein, 7 aa, artificial
  Synthetic polypeptide
STSSAYW

SEQ ID NO: 361 - protein, 7 aa, artificial
  Synthetic polypeptide
STSSDYW

SEQ ID NO: 362 - protein, 7 aa, artificial
  Synthetic polypeptide
STSSEYW

SEQ ID NO: 363 - protein, 7 aa, artificial
  Synthetic polypeptide
STSSGYW

SEQ ID NO: 364 - protein, 7 aa, artificial
  Synthetic polypeptide
STSSHYW

SEQ ID NO: 365 - protein, 7 aa, artificial
  Synthetic polypeptide
STSSMYW

SEQ ID NO: 366 - protein, 7 aa, artificial
  Synthetic polypeptide
STSSNYW

SEQ ID NO: 367 - protein, 7 aa, artificial
  Synthetic polypeptide
STSSQYW

SEQ ID NO: 368 - protein, 7 aa, artificial
  Synthetic polypeptide
STSSSYW

SEQ ID NO: 369 - protein, 7 aa, artificial
  Synthetic polypeptide
STSSTYW

SEQ ID NO: 370 - protein, 7 aa, artificial
  Synthetic polypeptide
STSSVYW

SEQ ID NO: 371 - protein, 7 aa, artificial
  Synthetic polypeptide
STSSWYW

SEQ ID NO: 372 - protein, 7 aa, artificial
  Synthetic polypeptide
STSSYAW

SEQ ID NO: 373 - protein, 7 aa, artificial
  Synthetic polypeptide
STSSYFW

SEQ ID NO: 374 - protein, 7 aa, artificial
  Synthetic polypeptide
STSSYGW

SEQ ID NO: 375 - protein, 7 aa, artificial
  Synthetic polypeptide
STSSYHW

SEQ ID NO: 376 - protein, 7 aa, artificial
  Synthetic polypeptide
STSSYMW

SEQ ID NO: 377 - protein, 7 aa, artificial
  Synthetic polypeptide
STSSYNW

SEQ ID NO: 378 - protein, 7 aa, artificial
  Synthetic polypeptide
STSSYQW

SEQ ID NO: 379 - protein, 12 aa, artificial
  Synthetic polypeptide
  VARIANT (1)..(1): X at 1 is S, F, I, M, or Q.
  VARIANT (2)..(2): X at 2 is I, A, G, L, R, S, T, or V.
  VARIANT (3)..(3): X at 3 is Y, A, D, E, F, G, H, K, L, M, N, P, Q, R, S, T, or W.
  VARIANT (4)..(4): X at 4 is Y, A, D, E, F, G, H, K, N, P, Q, R, S, T, or W.
  VARIANT (5)..(5): X at 5 is T, D, E, K, N, P, or Q.
  VARIANT (6)..(6): X at 6 is G, or Q.
  VARIANT (7)..(7): X at 7 is N, D, E, G, H, I, K, M, P, R, or S.
  VARIANT (8)..(8): X at 8 is T, A, E, F, G, H, K, P, Q, R, S, V, W, or Y.
  VARIANT (9)..(9): X at 9 is Y, or W.
  VARIANT (11)..(11): X at 11 is N, A, D, E, K, L, M, P, Q, S or T.
  misc_feature (11)..(11): Xaa can be any naturally occurring amino acid
XXXXXXXXXYXP

SEQ ID NO: 380 - protein, 12 aa, artificial
  Synthetic polypeptide
FIYYTGNTYYNP

SEQ ID NO: 381 - protein, 12 aa, artificial
  Synthetic polypeptide
IIYYTGNTYYNP

SEQ ID NO: 382 - protein, 12 aa, artificial
  Synthetic polypeptide
MIYYTGNTYYNP

SEQ ID NO: 383 - protein, 12 aa, artificial
  Synthetic polypeptide
QIYYTGNTYYNP

SEQ ID NO: 384 - protein, 12 aa, artificial
  Synthetic polypeptide
SAYYTGNTYYNP

SEQ ID NO: 385 - protein, 12 aa, artificial
  Synthetic polypeptide
SGYYTGNTYYNP

SEQ ID NO: 386 - protein, 12 aa, artificial
  Synthetic polypeptide
SLYYTGNTYYNP

SEQ ID NO: 387 - protein, 12 aa, artificial
  Synthetic polypeptide
SRYYTGNTYYNP

SEQ ID NO: 388 - protein, 12 aa, artificial
  Synthetic polypeptide
SSYYTGNTYYNP

SEQ ID NO: 389 - protein, 12 aa, artificial
  Synthetic polypeptide
STYYTGNTYYNP

SEQ ID NO: 390 - protein, 12 aa, artificial
  Synthetic polypeptide
SVYYTGNTYYNP

SEQ ID NO: 391 - protein, 12 aa, artificial
  Synthetic polypeptide
SIAYTGNTYYNP

SEQ ID NO: 392 - protein, 12 aa, artificial
  Synthetic polypeptide
SIDYTGNTYYNP

SEQ ID NO: 393 - protein, 12 aa, artificial
  Synthetic polypeptide
SIEYTGNTYYNP

SEQ ID NO: 394 - protein, 12 aa, artificial
  Synthetic polypeptide
SIFYTGNTYYNP

SEQ ID NO: 395 - protein, 12 aa, artificial
  Synthetic polypeptide
SIGYTGNTYYNP

SEQ ID NO: 396 - protein, 12 aa, artificial
  Synthetic polypeptide
SIHYTGNTYYNP

SEQ ID NO: 397 - protein, 12 aa, artificial
  Synthetic polypeptide
SIKYTGNTYYNP

SEQ ID NO: 398 - protein, 12 aa, artificial
  Synthetic polypeptide
SILYTGNTYYNP

SEQ ID NO: 399 - protein, 12 aa, artificial
  Synthetic polypeptide
SIMYTGNTYYNP

SEQ ID NO: 400 - protein, 12 aa, artificial
  Synthetic polypeptide
SINYTGNTYYNP

SEQ ID NO: 401 - protein, 12 aa, artificial
  Synthetic polypeptide
SIPYTGNTYYNP

SEQ ID NO: 402 - protein, 12 aa, artificial
  Synthetic polypeptide
SIQYTGNTYYNP

SEQ ID NO: 403 - protein, 12 aa, artificial
  Synthetic polypeptide
SIRYTGNTYYNP

SEQ ID NO: 404 - protein, 12 aa, artificial
  Synthetic polypeptide
SISYTGNTYYNP

SEQ ID NO: 405 - protein, 12 aa, artificial
  Synthetic polypeptide
SITYTGNTYYNP

SEQ ID NO: 406 - protein, 12 aa, artificial
  Synthetic polypeptide
SIWYTGNTYYNP

SEQ ID NO: 407 - protein, 12 aa, artificial
  Synthetic polypeptide
SIYATGNTYYNP

SEQ ID NO: 408 - protein, 12 aa, artificial
  Synthetic polypeptide
SIYDTGNTYYNP

SEQ ID NO: 409 - protein, 12 aa, artificial
  Synthetic polypeptide
SIYETGNTYYNP

SEQ ID NO: 410 - protein, 12 aa, artificial
  Synthetic polypeptide
SIYFTGNTYYNP

SEQ ID NO: 411 - protein, 12 aa, artificial
  Synthetic polypeptide
SIYGTGNTYYNP

SEQ ID NO: 412 - protein, 12 aa, artificial
  Synthetic polypeptide
SIYHTGNTYYNP

SEQ ID NO: 413 - protein, 12 aa, artificial
  Synthetic polypeptide
SIYKTGNTYYNP

SEQ ID NO: 414 - protein, 12 aa, artificial
  Synthetic polypeptide
SIYNTGNTYYNP

SEQ ID NO: 415 - protein, 12 aa, artificial
  Synthetic polypeptide
SIYPTGNTYYNP

SEQ ID NO: 416 - protein, 12 aa, artificial
  Synthetic polypeptide
SIYQTGNTYYNP

SEQ ID NO: 417 - protein, 12 aa, artificial
  Synthetic polypeptide
SIYRTGNTYYNP

SEQ ID NO: 418 - protein, 12 aa, artificial
  Synthetic polypeptide
SIYSTGNTYYNP

SEQ ID NO: 419 - protein, 12 aa, artificial
  Synthetic polypeptide
SIYTTGNTYYNP

SEQ ID NO: 420 - protein, 12 aa, artificial
  Synthetic polypeptide
SIYWTGNTYYNP

SEQ ID NO: 421 - protein, 12 aa, artificial
  Synthetic polypeptide
SIYYDGNTYYNP

SEQ ID NO: 422 - protein, 12 aa, artificial
  Synthetic polypeptide
SIYYEGNTYYNP

SEQ ID NO: 423 - protein, 12 aa, artificial
  Synthetic polypeptide
SIYYKGNTYYNP

SEQ ID NO: 424 - protein, 12 aa, artificial
  Synthetic polypeptide
SIYYNGNTYYNP

SEQ ID NO: 425 - protein, 12 aa, artificial
  Synthetic polypeptide
SIYYPGNTYYNP

SEQ ID NO: 426 - protein, 12 aa, artificial
  Synthetic polypeptide
SIYYQGNTYYNP

SEQ ID NO: 427 - protein, 12 aa, artificial
  Synthetic polypeptide
SIYYTQNTYYNP

SEQ ID NO: 428 - protein, 12 aa, artificial
  Synthetic polypeptide
SIYYTGDTYYNP

SEQ ID NO: 429 - protein, 12 aa, artificial
  Synthetic polypeptide
SIYYTGETYYNP

SEQ ID NO: 430 - protein, 12 aa, artificial
  Synthetic polypeptide
SIYYTGGTYYNP

SEQ ID NO: 431 - protein, 12 aa, artificial
  Synthetic polypeptide
SIYYTGHTYYNP

SEQ ID NO: 432 - protein, 12 aa, artificial
  Synthetic polypeptide
SIYYTGITYYNP

SEQ ID NO: 433 - protein, 12 aa, artificial
  Synthetic polypeptide
SIYYTGKTYYNP

SEQ ID NO: 434 - protein, 12 aa, artificial
  Synthetic polypeptide
SIYYTGMTYYNP

SEQ ID NO: 435 - protein, 12 aa, artificial
  Synthetic polypeptide
SIYYTGPTYYNP

SEQ ID NO: 436 - protein, 12 aa, artificial
  Synthetic polypeptide
SIYYTGRTYYNP

SEQ ID NO: 437 - protein, 12 aa, artificial
  Synthetic polypeptide
SIYYTGSTYYNP

SEQ ID NO: 438 - protein, 12 aa, artificial
  Synthetic polypeptide
SIYYTGNAYYNP

SEQ ID NO: 439 - protein, 12 aa, artificial
  Synthetic polypeptide
SIYYTGNEYYNP

SEQ ID NO: 440 - protein, 12 aa, artificial
  Synthetic polypeptide
SIYYTGNFYYNP

SEQ ID NO: 441 - protein, 12 aa, artificial
  Synthetic polypeptide
SIYYTGNGYYNP

SEQ ID NO: 442 - protein, 12 aa, artificial
  Synthetic polypeptide
SIYYTGNHYYNP

SEQ ID NO: 443 - protein, 12 aa, artificial
  Synthetic polypeptide
SIYYTGNKYYNP

SEQ ID NO: 444 - protein, 12 aa, artificial
  Synthetic polypeptide
SIYYTGNPYYNP

SEQ ID NO: 445 - protein, 12 aa, artificial
  Synthetic polypeptide
SIYYTGNQYYNP

SEQ ID NO: 446 - protein, 12 aa, artificial
  Synthetic polypeptide
SIYYTGNRYYNP

SEQ ID NO: 447 - protein, 12 aa, artificial
  Synthetic polypeptide
SIYYTGNSYYNP

SEQ ID NO: 448 - protein, 12 aa, artificial
  Synthetic polypeptide
SIYYTGNVYYNP

SEQ ID NO: 449 - protein, 12 aa, artificial
  Synthetic polypeptide
SIYYTGNWYYNP

SEQ ID NO: 450 - protein, 12 aa, artificial
  Synthetic polypeptide
SIYYTGNYYYNP

SEQ ID NO: 451 - protein, 12 aa, artificial
  Synthetic polypeptide
SIYYTGNTWYNP

SEQ ID NO: 452 - protein, 12 aa, artificial
  Synthetic polypeptide
SIYYTGNTYYAP

SEQ ID NO: 453 - protein, 12 aa, artificial
  Synthetic polypeptide
SIYYTGNTYYDP

SEQ ID NO: 454 - protein, 12 aa, artificial
  Synthetic polypeptide
SIYYTGNTYYEP

SEQ ID NO: 455 - protein, 12 aa, artificial
  Synthetic polypeptide
SIYYTGNTYYKP

SEQ ID NO: 456 - protein, 12 aa, artificial
  Synthetic polypeptide
SIYYTGNTYYLP

SEQ ID NO: 457 - protein, 12 aa, artificial
  Synthetic polypeptide
SIYYTGNTYYMP

SEQ ID NO: 458 - protein, 12 aa, artificial
  Synthetic polypeptide
SIYYTGNTYYPP

SEQ ID NO: 459 - protein, 12 aa, artificial
  Synthetic polypeptide
SIYYTGNTYYQP

SEQ ID NO: 460 - protein, 12 aa, artificial
  Synthetic polypeptide
SIYYTGNTYYSP

SEQ ID NO: 461 - protein, 12 aa, artificial
  Synthetic polypeptide
SIYYTGNTYYTP

SEQ ID NO: 462 - protein, 15 aa, artificial
  Synthetic polypeptide
  VARIANT (1)..(1): X at 1 is A, or V.
  VARIANT (2)..(2): X at 2 is R, A, G, N, Q, or T.
  VARIANT (3)..(3): X at 3 is V, A, F, I, K, L, M, Q, or S.
  VARIANT (4)..(4): X at 4 is R, A, I, K, L, M, P, Q, S, T, or V.
  VARIANT (5)..(5): X at 5 is Y, H, I, L, or V.
  VARIANT (7)..(7): X at 7 is V, A, F, G, K, M, N, Q, R, S, T, W, or Y.
  VARIANT (8)..(8): X at 8 is G, N, R, S, or T.
  VARIANT (12)..(12): X at 12 is Y, F, H, I, L, M, Q, or R.
XXXXXGXXVPRXFDP

SEQ ID NO: 463 - protein, 15 aa, artificial
  Synthetic polypeptide
VRVRYGVGVPRYFDP

SEQ ID NO: 464 - protein, 15 aa, artificial
  Synthetic polypeptide
AAVRYGVGVPRYFDP

SEQ ID NO: 465 - protein, 15 aa, artificial
  Synthetic polypeptide
AGVRYGVGVPRYFDP

SEQ ID NO: 466 - protein, 15 aa, artificial
  Synthetic polypeptide
ANVRYGVGVPRYFDP

SEQ ID NO: 467 - protein, 15 aa, artificial
  Synthetic polypeptide
AQVRYGVGVPRYFDP

SEQ ID NO: 468 - protein, 15 aa, artificial
  Synthetic polypeptide
ATVRYGVGVPRYFDP

SEQ ID NO: 469 - protein, 15 aa, artificial
  Synthetic polypeptide
ARARYGVGVPRYFDP

SEQ ID NO: 470 - protein, 15 aa, artificial
  Synthetic polypeptide
ARFRYGVGVPRYFDP

SEQ ID NO: 471 - protein, 15 aa, artificial
  Synthetic polypeptide
ARIRYGVGVPRYFDP

SEQ ID NO: 472 - protein, 15 aa, artificial
  Synthetic polypeptide
ARKRYGVGVPRYFDP

SEQ ID NO: 473 - protein, 15 aa, artificial
  Synthetic polypeptide
ARLRYGVGVPRYFDP

SEQ ID NO: 474 - protein, 15 aa, artificial
  Synthetic polypeptide
ARMRYGVGVPRYFDP

SEQ ID NO: 475 - protein, 15 aa, artificial
  Synthetic polypeptide
ARQRYGVGVPRYFDP

SEQ ID NO: 476 - protein, 15 aa, artificial
  Synthetic polypeptide
ARSRYGVGVPRYFDP

SEQ ID NO: 477 - protein, 15 aa, artificial
  Synthetic polypeptide
ARVAYGVGVPRYFDP

SEQ ID NO: 478 - protein, 15 aa, artificial
  Synthetic polypeptide
ARVIYGVGVPRYFDP

SEQ ID NO: 479 - protein, 15 aa, artificial
  Synthetic polypeptide
ARVKYGVGVPRYFDP

SEQ ID NO: 480 - protein, 15 aa, artificial
  Synthetic polypeptide
ARVLYGVGVPRYFDP

SEQ ID NO: 481 - protein, 15 aa, artificial
  Synthetic polypeptide
ARVMYGVGVPRYFDP

SEQ ID NO: 482 - protein, 15 aa, artificial
  Synthetic polypeptide
ARVPYGVGVPRYFDP

SEQ ID NO: 483 - protein, 15 aa, artificial
  Synthetic polypeptide
ARVQYGVGVPRYFDP

SEQ ID NO: 484 - protein, 15 aa, artificial
  Synthetic polypeptide
ARVSYGVGVPRYFDP

SEQ ID NO: 485 - protein, 15 aa, artificial
  Synthetic polypeptide
ARVTYGVGVPRYFDP

SEQ ID NO: 486 - protein, 15 aa, artificial
  Synthetic polypeptide
ARVVYGVGVPRYFDP

SEQ ID NO: 487 - protein, 15 aa, artificial
  Synthetic polypeptide
ARVRHGVGVPRYFDP

SEQ ID NO: 488 - protein, 15 aa, artificial
  Synthetic polypeptide
ARVRIGVGVPRYFDP

SEQ ID NO: 489 - protein, 15 aa, artificial
  Synthetic polypeptide
ARVRLGVGVPRYFDP

SEQ ID NO: 490 - protein, 15 aa, artificial
  Synthetic polypeptide
ARVRVGVGVPRYFDP

SEQ ID NO: 491 - protein, 15 aa, artificial
  Synthetic polypeptide
ARVRYGAGVPRYFDP

SEQ ID NO: 492 - protein, 15 aa, artificial
  Synthetic polypeptide
ARVRYGFGVPRYFDP

SEQ ID NO: 493 - protein, 15 aa, artificial
  Synthetic polypeptide
ARVRYGGGVPRYFDP

SEQ ID NO: 494 - protein, 15 aa, artificial
  Synthetic polypeptide
ARVRYGKGVPRYFDP

SEQ ID NO: 495 - protein, 15 aa, artificial
  Synthetic polypeptide
ARVRYGMGVPRYFDP

SEQ ID NO: 496 - protein, 15 aa, artificial
  Synthetic polypeptide
ARVRYGNGVPRYFDP

SEQ ID NO: 497 - protein, 15 aa, artificial
  Synthetic polypeptide
ARVRYGQGVPRYFDP

SEQ ID NO: 498 - protein, 15 aa, artificial
  Synthetic polypeptide
ARVRYGRGVPRYFDP

SEQ ID NO: 499 - protein, 15 aa, artificial
  Synthetic polypeptide
ARVRYGSGVPRYFDP

SEQ ID NO: 500 - protein, 15 aa, artificial
  Synthetic polypeptide
ARVRYGTGVPRYFDP

SEQ ID NO: 501 - protein, 15 aa, artificial
  Synthetic polypeptide
ARVRYGWGVPRYFDP

SEQ ID NO: 502 - protein, 15 aa, artificial
  Synthetic polypeptide
ARVRYGYGVPRYFDP

SEQ ID NO: 503 - protein, 15 aa, artificial
  Synthetic polypeptide
ARVRYGVNVPRYFDP

SEQ ID NO: 504 - protein, 15 aa, artificial
  Synthetic polypeptide
ARVRYGVRVPRYFDP

SEQ ID NO: 505 - protein, 15 aa, artificial
  Synthetic polypeptide
ARVRYGVSVPRYFDP

SEQ ID NO: 506 - protein, 15 aa, artificial
  Synthetic polypeptide
ARVRYGVTVPRYFDP

SEQ ID NO: 507 - protein, 15 aa, artificial
  Synthetic polypeptide
ARVRYGVGVPRFFDP

SEQ ID NO: 508 - protein, 15 aa, artificial
  Synthetic polypeptide
ARVRYGVGVPRHFDP

SEQ ID NO: 509 - protein, 15 aa, artificial
  Synthetic polypeptide
ARVRYGVGVPRIFDP

SEQ ID NO: 510 - protein, 15 aa, artificial
  Synthetic polypeptide
ARVRYGVGVPRLFDP

SEQ ID NO: 511 - protein, 15 aa, artificial
  Synthetic polypeptide
ARVRYGVGVPRMFDP

SEQ ID NO: 512 - protein, 15 aa, artificial
  Synthetic polypeptide
ARVRYGVGVPRQFDP

SEQ ID NO: 513 - protein, 15 aa, artificial
  Synthetic polypeptide
ARVRYGVGVPRRFDP

SEQ ID NO: 514 - DNA, 20 bp, artificial
  Synthetic oligonucleotide
taagcttggccgccatggcc

SEQ ID NO: 515 - DNA, 20 bp, artificial
  Synthetic oligonucleotide
acccggagacagggagaggc

SEQ ID NO: 516 - DNA, 25 bp, artificial
  Synthetic oligonucleotide
ctgtctccgggttaagattacaagg

SEQ ID NO: 517 - DNA, 25 bp, artificial
  Synthetic oligonucleotide
ccttgtaatcttaacccggagacag

SEQ ID NO: 518 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 520 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 521 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 523 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 524 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 525 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 526 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 527 - protein, 452 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - protein, 451 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 529 - protein, 452 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 530 - protein, 452 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 531 - protein, 451 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 532 - protein, 452 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - protein, 452 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 534 - protein, 451 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 535 - protein, 452 aa, artificial
  Synthetic polypeptide
ELQLQESGPGLVKPSETLSLTCTVSGGSITSTNYYWGWIRQPPGKGLEWIGNIDYTGSTYYNASLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 536 - protein, 452 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 537 - protein, 451 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 538 - protein, 452 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 539 - protein, 452 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 451 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 541 - protein, 452 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 452 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 543 - protein, 451 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 544 - protein, 452 aa, artificial
  Synthetic polypeptide
ELQLQESGPGLVKPSETLSLTCTVSGGSITSSNAYWGWIRQPPGKGLEWIGSIDYTGSTAYNPSLKSRVTISVDTSKNQFSLKLSSVTAADTAVYYCAHGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 545 - protein, 452 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 546 - protein, 451 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 547 - protein, 452 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 548 - protein, 452 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 549 - protein, 451 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 550 - protein, 452 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 551 - protein, 452 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 552 - protein, 451 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 553 - protein, 452 aa, artificial
  Synthetic polypeptide
ELQLQESGPGLVKPSETLSLTCTVSGGSITASNYYWGWIRQPPGKGLEWIGSIDYTGSTYYNTSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 554 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 555 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 556 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 557 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 558 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 559 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 560 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 561 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 562 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 563 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 564 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 565 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 566 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 567 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 568 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 569 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 570 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 571 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGSYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 572 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 573 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 574 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 575 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 576 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 577 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 579 - protein, 451 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 580 - protein, 452 aa, artificial
  Synthetic polypeptide
ELQLQESGPGLVKPSETLSLTCTVSGGSITASNYYWGWIRQPPGKGLEWIGSIDYTGSTYYEPSLKSRVTISVDTSKNQFSLKLSSVTAADTAVYYCATGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 581 - protein, 452 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 582 - protein, 451 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 583 - protein, 452 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 584 - protein, 452 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 585 - protein, 451 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 586 - protein, 452 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - protein, 452 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 588 - protein, 451 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 589 - protein, 452 aa, artificial
  Synthetic polypeptide
ELQLQESGPGLVKPSETLSLTCTVSGGSITASNTYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 590 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 591 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 592 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 593 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 594 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 595 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 596 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 597 - protein, 451 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 598 - protein, 452 aa, artificial
  Synthetic polypeptide
ELQLQESGPGLVKPSETLSLTCTVSGGSITASNYYWGWIRQPPGKGLEWIGSIDYTGSTYYNPSLKSRVTISVDTSKNQFSLKLSSVTAADTAVYYCASGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 599 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 600 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 601 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 602 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 603 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 604 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 605 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 606 - protein, 451 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 607 - protein, 452 aa, artificial
  Synthetic polypeptide
ELQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCATGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 608 - protein, 452 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 451 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 610 - protein, 452 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 611 - protein, 452 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 612 - protein, 451 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 613 - protein, 452 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 614 - protein, 452 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 615 - protein, 451 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 616 - protein, 452 aa, artificial
  Synthetic polypeptide
ELQLQESGPGLVKPSETLSLTCTVSGGSITSSNYYWGWIRQPPGKGLEWIGSIDYTGSTYYQPSLKSRVTISVDTSKNQFSLKLSSVTAADTAVYYCARGNYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 617 - protein, 453 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 618 - protein, 452 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 619 - protein, 453 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 620 - protein, 453 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 621 - protein, 452 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 622 - protein, 453 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 623 - protein, 453 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 624 - protein, 452 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 625 - protein, 453 aa, artificial
  Synthetic polypeptide
ELQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 626 - protein, 453 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 452 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 628 - protein, 453 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 629 - protein, 453 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 630 - protein, 452 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 631 - protein, 453 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 632 - protein, 453 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 633 - protein, 452 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 634 - protein, 453 aa, artificial
  Synthetic polypeptide
ELQLQESGPGLVKPSETLSLTCTVSGGSISDSSYYWGWIRQPPGKGLEWIGSIYYTGNTYYNSSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 635 - protein, 453 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 636 - protein, 452 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 637 - protein, 453 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 638 - protein, 453 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 639 - protein, 452 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 640 - protein, 453 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - protein, 453 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 642 - protein, 452 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 643 - protein, 453 aa, artificial
  Synthetic polypeptide
ELQLQESGPGLVKPSETLSLTCTVSGGSISESSYYWGWIRQPPGKGLEWIGSIYYTGNTYYNPSLKSRVTISVDTSKNQFSLKLSSVTAADTAVYYCAGVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 644 - protein, 453 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 645 - protein, 452 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 646 - protein, 453 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 647 - protein, 453 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 648 - protein, 452 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 649 - protein, 453 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 650 - protein, 453 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 651 - protein, 452 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 652 - protein, 453 aa, artificial
  Synthetic polypeptide
ELQLQESGPGLVKPSETLSLTCTVSGGSISTSSDYWGWIRQPPGKGLEWIGSIYYTGNTYYLPSLKSRVTISVDTSKNQFSLKLSSVTAADTAVYYCSRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 653 - protein, 453 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 654 - protein, 452 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 655 - protein, 453 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 656 - protein, 453 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 657 - protein, 452 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 658 - protein, 453 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 659 - protein, 453 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 660 - protein, 452 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 661 - protein, 453 aa, artificial
  Synthetic polypeptide
ELQLQESGPGLVKPSETLSLTCTVSGGSISNSSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 662 - protein, 453 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 663 - protein, 452 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 664 - protein, 453 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 665 - protein, 453 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 666 - protein, 452 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 667 - protein, 453 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 668 - protein, 453 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 669 - protein, 452 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 670 - protein, 453 aa, artificial
  Synthetic polypeptide
ELQLQESGPGLVKPSETLSLTCTVSGGSISESSYYWGWIRQPPGKGLEWIGSIYYTGNTYYLPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 671 - protein, 453 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 672 - protein, 452 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 673 - protein, 453 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 674 - protein, 453 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - protein, 452 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 676 - protein, 453 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 677 - protein, 453 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 678 - protein, 452 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 679 - protein, 453 aa, artificial
  Synthetic polypeptide
ELQLQESGPGLVKPSETLSLTCTVSGGSISTSSYHWGWIRQPPGKGLEWIGSIYYTGNTYYMPSLKSRVTISVDTSKNQFSLKLSSVTAADTAVYYCVRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 680 - protein, 453 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 681 - protein, 452 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 682 - protein, 453 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 683 - protein, 453 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 684 - protein, 452 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 685 - protein, 453 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 686 - protein, 453 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 687 - protein, 452 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 688 - protein, 453 aa, artificial
  Synthetic polypeptide
ELQLQESGPGLVKPSETLSLTCTVSGGSISRSSYYWGWIRQPPGKGLEWIGSIYYTGNTYYWPSLKSRVTISVDTSKNQFSLKLSSVTAADTAVYYCTRVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 689 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 690 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 691 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 692 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 693 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 694 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 695 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 696 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 697 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 698 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 699 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 700 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 701 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 702 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 703 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 704 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 705 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 706 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 707 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 708 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 709 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 710 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 711 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 712 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 713 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 714 - protein, 452 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 715 - protein, 453 aa, artificial
  Synthetic polypeptide
ELQLQESGPGLVKPSETLSLTCTVSGGSISDSSYYWGWIRQPPGKGLEWIGSIYYTGETYYAPSLKSRVTISVDTSKNQFSLKLSSVTAADTAVYYCARVRYGVGVPRHFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 716 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 717 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 718 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 719 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 720 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 721 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 722 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 723 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 724 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARLRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 725 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 726 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 727 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 728 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 729 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 730 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 731 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 732 - protein, 452 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 733 - protein, 453 aa, artificial
  Synthetic polypeptide
ELQLQESGPGLVKPSETLSLTCTVSGGSISESSYYWGWIRQPPGKGLEWIGSIYYTGETYYAPSLKSRVTISVDTSKNQFSLKLSSVTAADTAVYYCARVKYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 734 - protein, 453 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 735 - protein, 452 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 736 - protein, 453 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 737 - protein, 453 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 738 - protein, 452 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 739 - protein, 453 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 740 - protein, 453 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 741 - protein, 452 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 742 - protein, 453 aa, artificial
  Synthetic polypeptide
QLQLQESGPGLVKPSETLSLTCTVSGGSISTSSYYWGWIRQPPGKGLEWIGSIYYTGNTYYNPSLKSRVTISVDTSKNQFSLKLSSVTAADTAVYYCARVRYGVGVPRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTYITRETPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 743 - protein, 452 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 744 - protein, 451 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 745 - protein, 452 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 746 - protein, 452 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 747 - protein, 451 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 748 - protein, 452 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 749 - protein, 452 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 750 - protein, 451 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 751 - protein, 452 aa, artificial
  Synthetic polypeptide
QLQLQESGPGLVKPSETLSLTCTVSGGSITSSNYYWGWIRQPPGKGLEWIGSIDYTGSTYYNPSLKSRVTISVDTSKNQFSLKLSSVTAADTAVYYCARGKYYETYLGFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

What is claimed is:

1. An anti-IL-36 antibody comprising: (i) a light chain variable domain ($V_L$) comprising a first light chain hypervariable region (HVR-L1), a second light chain hypervariable region (HVR-L2), and a third light chain hypervariable region (HVR-L3) and (ii) a heavy chain variable domain ($V_H$) comprising a first heavy chain hypervariable region (HVR-H1), a second heavy chain hypervariable region (HVR-H2), and a third heavy chain hypervariable region (HVR-H3); wherein:

HVR-L1 comprises the amino acid sequence of SEQ ID NO: 18, HVR-L2 comprises the amino acid sequence of SEQ ID NO: 19, HVR-L3 comprises the amino acid sequence of SEQ ID NO: 20, HVR-H1 comprises the amino acid sequence of SEQ ID NO: 158, HVR-H2 comprises the amino acid sequence of SEQ ID NO: 159, and HVR-H3 comprises the amino acid sequence of SEQ ID NO: 160;

HVR-L1 comprises the amino acid sequence of SEQ ID NO: 18, HVR-L2 comprises the amino acid sequence of SEQ ID NO: 19, HVR-L3 comprises the amino acid sequence of SEQ ID NO: 20, HVR-H1 comprises the amino acid sequence of SEQ ID NO: 106, HVR-H2 comprises the amino acid sequence of SEQ ID NO: 107, and HVR-H3 comprises the amino acid sequence of SEQ ID NO: 108;

HVR-L1 comprises the amino acid sequence of SEQ ID NO: 34, HVR-L2 comprises the amino acid sequence of SEQ ID NO: 35, HVR-L3 comprises the amino acid sequence of SEQ ID NO: 36, HVR-H1 comprises the amino acid sequence of SEQ ID NO: 66, HVR-H2 comprises the amino acid sequence of SEQ ID NO: 67, and HVR-H3 comprises the amino acid sequence of SEQ ID NO: 68, or HVR-L1 comprises the amino acid sequence of SEQ ID NO: 18, HVR-L2 comprises the amino acid sequence of SEQ ID NO: 19, HVR-L3 comprises the amino acid sequence of SEQ ID NO: 20, HVR-H1 comprises the amino acid sequence of SEQ ID NO: 50, HVR-H2 comprises the amino acid sequence of SEQ ID NO: 51, and HVR-H3 comprises the amino acid sequence of SEQ ID NO: 52.

2. The antibody of claim 1, the $V_L$ domain has at least 90% identity to SEQ ID NO: 77 and $V_H$ domain has at least 90% identity to SEQ ID NO: 157; or the $V_L$ domain has at least 90% identity to SEQ ID NO: 77 and the $V_H$ domain has at least 90% identity to SEQ ID NO: 105; or the $V_L$ domain has at least 90% identity to SEQ ID NO: 78 and the $V_H$ domain has at least 90% identity to SEQ ID NO: 80; or the $V_L$ domain has at least 90% identity to SEQ ID NO: 77 and the $V_H$ domain has at least 90% identity to SEQ ID NO: 79.

3. The antibody of claim 1, wherein:

the light chain amino acid sequence has at least 90% identity to SEQ ID NO: 169 and the heavy chain amino acid sequence has at least 90% identity to a sequence selected from the group consisting of SEQ ID NOs: 191, 192, 193, 203, 204, 205, 233, 234, and 235; or the light chain amino acid sequence has at least 90% identity to SEQ ID NO: 242 and the heavy chain amino acid sequence has at least 90% identity to a sequence selected from SEQ ID NOs: 170, 171, and 172.

4. The antibody of claim 1, wherein the antibody is a multispecific antibody comprising:

a pair of light chains each comprising a $V_L$ domain comprising: the HVR-L1 sequence of SEQ ID NO: 18; the HVR-L2 sequence of SEQ ID NO: 19; and the HVR-L3 sequence of SEQ ID NO: 20;

a first heavy chain comprising a $V_H$ domain comprising: the HVR-H1 sequence of SEQ ID NO: 158; the HVR-H2 sequence of SEQ ID NO: 159; and the HVR-H3 sequence of SEQ ID NO: 160; and a second heavy chain comprising a $V_H$ domain comprising: the HVR-H1 sequence of SEQ ID NO: 106; the HVR-H2 sequence of SEQ ID NO: 107; and the HVR-H3 sequence of SEQ ID NO: 108.

5. The antibody of claim 4, wherein one of the first heavy chain and second heavy chain comprises the amino acid substitution T336W and the other of the first heavy chain and the second heavy chain comprises the amino acid substitutions T366S, L368A and Y407V.

6. The antibody of claim 4, wherein:

(a) the pair of light chains each comprises a light chain variable domain ($V_L$) having the amino acid sequence of SEQ ID NO: 77;

(b) the first heavy chain comprises a heavy chain variable domain ($V_H$) having the amino acid sequence of SEQ ID NO: 157; and (c) The second heavy chain comprises a heavy chain variable domain ($V_H$) having the amino acid sequence of SEQ ID NO: 105.

7. The antibody of claim 1, wherein the antibody binds to hu-IL-36α, hu-IL-36-β, and/or hu-IL-36-γ with a binding affinity of $1\times10^{-8}$ M or less, $1\times10^{-9}$ M or less, $1\times10^{-10}$ M or less, or $1\times10^{-11}$ M or less;

the antibody binds to hu-IL-36α and hu-IL-36-γ with a binding affinity of $1\times10^{-8}$ M or less;

the antibody binds to hu-IL-36-β with a binding affinity of $1\times10^{-8}$ M or less;

the antibody decreases an intracellular signal stimulated by IL-36α, IL-36β, and/or IL-36γ by at least 90%;

the antibody inhibits release of IL-8 from primary human keratinocytes (PHKs) stimulated by IL-36α, IL-36β, and/or IL-36γ; and/or the antibody cross-reacts with an IL-36α, IL-36β, or IL-36γ of cynomolgus monkey having the amino acid sequence of SEQ ID NO: 5, 6, or 7.

8. The antibody of claim 7, wherein the antibody decreases an intracellular signal stimulated by IL-36α, IL-36β, and/or IL-36γ by at least 90%, and wherein said IL-36α has a concentration of about 1.2 nM, said IL-36β has a concentration of about 0.3 nM, and/or said IL-36γ has a concentration of about 7 nM and the antibody has an $IC_{50}$ of 10 nM or less.

9. The antibody of claim 8, wherein the first arm binds to hu-IL-36α, or hu-IL-36-γ with a binding affinity of $1 \times 10^{-9}$ M or less, and the second arm binds hu-IL-36β with a binding affinity of $1 \times 10^{-9}$ M or less.

10. The antibody of claim 7, wherein the antibody inhibits release of IL-8 from primary human keratinocytes (PHKs) stimulated by IL-36α, IL-36β, and/or IL-36γ, and wherein said IL-36α has a concentration of about 1.2 nM, said IL-36β has a concentration of about 0.3 nM, and/or said IL-36γ has a concentration of about 7 nM and the antibody has an $IC_{50}$ of 10 nM or less.

11. A composition comprising an antibody of claim and a pharmaceutically acceptable carrier.

12. A multispecific antibody comprising a pair of light chains (LC) wherein each LC comprises the sequence of SEQ ID NO: 169 and a first and second heavy chain (HC), wherein the first HC comprises the sequence of SEQ ID NO: 235 and the second HC comprises SEQ ID NO: 192.

13. The antibody of claim 12, having a binding affinity that is measured by equilibrium dissociation constant (KD) to a hu-IL-36α of SEQ ID NO:1, a hu-IL-36β of SEQ ID NO:2, and a hu-IL-36γ of SEQ ID NO:3.

14. The antibody of claim 13, wherein said IL-36α has a concentration of about 1.2 nM, said IL-36β has a concentration of about 0.3 nM, and/or said IL-36γ has a concentration of about 7 nM and the antibody has an $IC_{50}$ of 10 nM or less.

15. The antibody of claim 12, wherein the antibody comprises a specificity for IL36α or IL-36γ in a first arm, and a specificity for IL-36β in a second arm.

16. The antibody of claim 12, wherein the antibody decreases an intracellular signal stimulated by IL-36α, IL-36β, or IL-36γ by at least 90%.

17. The antibody of claim 16, wherein said IL-36α has a concentration of about 1.2 nM, said IL-36β has a concentration of about 0.3 nM, or said IL-36γ has a concentration of about 7 nM and the antibody has an $IC_{50}$ of 10 nM or less.

18. The antibody of claim 12, wherein the antibody inhibits release of IL-8 from primary human keratinocytes (PHKs) stimulated by IL-36α, IL-36β, or IL-36γ.

19. The antibody of claim 12, wherein the antibody cross-reacts with IL-36α, IL-36β, or IL-36γ of cynomolgus monkey.

20. The antibody of claim 12, wherein the antibody binds to each of cynomolgus monkey IL-36α, IL-36β, and IL-36γ with a binding affinity of 3 nM or less.

21. The antibody of claim 20, wherein the binding affinity to cynomolgus monkey IL-36α, IL-36β, and IL-36γ is measured by equilibrium dissociation constant (KD) to a cy-IL-36α of SEQ ID NO: 5, a cy-IL-36β of SEQ ID NO: 6, and a cy-IL-36γ of SEQ ID NO: 7.

22. An anti-IL-36 antibody comprising:
a light chain variable domain ($V_L$) comprising the amino acid sequence of SEQ ID NO: 77 and a heavy chain variable domain ($V_H$) comprising the amino acid sequence of SEQ ID NO: 157;
a light chain variable domain ($V_L$) comprising the amino acid sequence of SEQ ID NO: 77 and a heavy chain variable domain ($V_H$) comprising the amino acid sequence of SEQ ID NO: 105;
a light chain variable domain ($V_L$) comprising the amino acid sequence of SEQ ID NO: 78 and a heavy chain variable domain ($V_H$) comprising the amino acid sequence of SEQ ID NO: 80; or
a light chain variable domain ($V_L$) comprising the amino acid sequence of SEQ ID NO: 77 and a heavy chain variable domain ($V_H$) comprising the amino acid sequence of SEQ ID NO: 79.

23. An anti-IL-36 antibody comprising:
a light chain comprising the amino acid sequence of SEQ ID NO: 169 and a heavy chain comprising the amino acid sequence of a sequence selected from the group consisting of SEQ ID NOs: 191, 192, 193, 203, 204, 205, 233, 234, and 235; or
a light chain comprising the amino acid sequence of SEQ ID NO: 242 and a heavy chain comprising the amino acid sequence of sequence selected from SEQ ID NOs: 170, 171, and 172.

* * * * *